(12) United States Patent
Hansen et al.

(10) Patent No.: US 11,559,580 B1
(45) Date of Patent: *Jan. 24, 2023

(54) TISSUE-HOMING PEPTIDE CONJUGATES AND METHODS OF USE THEREOF

(71) Applicant: Blaze Bioscience, Inc., Seattle, WA (US)

(72) Inventors: Stacey J. Hansen, Renton, WA (US); Claudia Jochheim, Seattle, WA (US); Dennis M. Miller, Woodinville, WA (US); Natalie Winblade Nairn, Seattle, WA (US); Julia E. Novak, Sequim, WA (US); Mark R. Stroud, Seattle, WA (US); Valorie R. Wiss, Moscow, ID (US); Kelly Byrnes-Blake, Sultan, WA (US); Scott Presnell, Tacoma, WA (US)

(73) Assignee: BLAZE BIOSCIENCE, INC., Seattle, WA (US)

( * ) Notice: Subject to any disclaimer, the term of this patent is extended or adjusted under 35 U.S.C. 154(b) by 39 days.

This patent is subject to a terminal disclaimer.

(21) Appl. No.: 17/409,661

(22) Filed: Aug. 23, 2021

Related U.S. Application Data

(60) Continuation-in-part of application No. 17/230,353, filed on Apr. 14, 2021, and a continuation-in-part of application No. 16/704,955, filed on Dec. 5, 2019, application No. 17/230,353, which is a continuation of application No. 16/492,914, filed as application No. PCT/US2018/023006 on Mar. 16, 2018, now Pat. No. 11,013,814, application No. 16/704,955, which is a division of application No. 14/855,355, filed on Sep. 15, 2015, now abandoned, which is a
(Continued)

(51) Int. Cl.
| | |
|---|---|
| *A61K 38/00* | (2006.01) |
| *A61K 47/64* | (2017.01) |
| *A61K 47/65* | (2017.01) |
| *A61P 19/02* | (2006.01) |
| *A61P 13/12* | (2006.01) |
| *A61B 5/00* | (2006.01) |
| *A61B 6/03* | (2006.01) |
| *A61B 6/00* | (2006.01) |
| *A61K 49/00* | (2006.01) |
| *A61K 51/08* | (2006.01) |
| *C07K 14/435* | (2006.01) |
| *C07K 14/47* | (2006.01) |
| *C07K 16/24* | (2006.01) |
| *A61B 5/055* | (2006.01) |
| *A61B 8/08* | (2006.01) |

(52) U.S. Cl.
CPC ........ *A61K 47/6415* (2017.08); *A61B 5/0071* (2013.01); *A61B 6/037* (2013.01); *A61B 6/4057* (2013.01); *A61B 6/481* (2013.01); *A61K 47/65* (2017.08); *A61K 49/0056* (2013.01); *A61K 49/0058* (2013.01); *A61K 51/08* (2013.01); *A61P 13/12* (2018.01); *A61P 19/02* (2018.01); *C07K 14/43518* (2013.01); *C07K 14/43522* (2013.01); *C07K 14/4726* (2013.01); *C07K 16/244* (2013.01); *C07K 16/248* (2013.01); *A61B 5/055* (2013.01); *A61B 8/481* (2013.01); *A61B 2505/05* (2013.01); *C07K 2319/30* (2013.01); *C07K 2319/33* (2013.01); *C07K 2319/50* (2013.01)

(58) Field of Classification Search
CPC ................. A61B 6/481; C07K 14/435; C07K 14/43518; C07K 14/43522; C07K 14/4726; C07K 16/22; C07K 16/244; C07K 16/248; C07K 16/2875; C07K 16/2887; C07K 16/42; C07K 2317/21; C07K 2319/21; C07K 2319/30; C07K 2319/33; C07K 2319/43; C07K 2319/50; G01N 33/57484

See application file for complete search history.

(56) References Cited

U.S. PATENT DOCUMENTS

| | | | |
|---|---|---|---|
| 4,414,148 | A | 11/1983 | Jansen et al. |
| 4,444,744 | A | 4/1984 | Goldenberg |
| 4,569,789 | A | 2/1986 | Blattler et al. |

(Continued)

FOREIGN PATENT DOCUMENTS

| | | | |
|---|---|---|---|
| CA | 2993891 | A1 | 1/2017 |
| CN | 1924006 | A | 3/2007 |

(Continued)

OTHER PUBLICATIONS

Adelstein S.J., et al., "Radiotoxicity of Lodine-125 and other Auger-Electron-Emitting Radionuclides: Background to Therapy," Cancer Biother Radiopharm, Jun. 2003, vol. 18 (3), pp. 301-316.
(Continued)

*Primary Examiner* — Aradhana Sasan
*Assistant Examiner* — Mercy H Sabila
(74) *Attorney, Agent, or Firm* — DLA Piper LLP

(57) ABSTRACT

Peptides that home, target, migrate to, are directed to, are retained by, or accumulate in and/or bind to the cartilage or kidney of a subject are disclosed. Pharmaceutical compositions and uses for peptides or peptide-active agent complexes comprising such peptides are also disclosed. Such compositions can be formulated for targeted delivery of an active agent to a target region, tissue, structure or cell in the cartilage. Targeted compositions of the disclosure can deliver peptide or peptide-active agent complexes to target regions, tissues, structures, or cells targeted by the peptide.

20 Claims, 57 Drawing Sheets

Specification includes a Sequence Listing.

Related U.S. Application Data continuation of application No. PCT/US2014/056177, filed on Sep. 17, 2014.

(60) Provisional application No. 62/472,485, filed on Mar. 16, 2017, provisional application No. 61/990,101, filed on May 7, 2014, provisional application No. 61/879,096, filed on Sep. 17, 2013, provisional application No. 61/879,108, filed on Sep. 17, 2013.

(56) References Cited

U.S. PATENT DOCUMENTS

| | | |
|---|---|---|
| 4,659,839 A | 4/1987 | Nicolotti et al. |
| 4,671,958 A | 6/1987 | Rodwell et al. |
| 4,680,338 A | 7/1987 | Sundoro |
| 4,699,784 A | 10/1987 | Shih et al. |
| 5,051,364 A | 9/1991 | Isacke et al. |
| 5,212,290 A | 5/1993 | Vogelstein et al. |
| 5,223,253 A | 6/1993 | Hall et al. |
| 5,236,844 A | 8/1993 | Basset et al. |
| 5,314,992 A | 5/1994 | Guyre et al. |
| 5,591,829 A | 1/1997 | Matsushita |
| 5,626,862 A | 5/1997 | Brem et al. |
| 5,688,773 A | 11/1997 | Chiocca et al. |
| 5,750,376 A | 5/1998 | Weiss et al. |
| 5,756,340 A | 5/1998 | Hammock et al. |
| 5,866,570 A | 2/1999 | Liang et al. |
| 5,905,027 A | 5/1999 | Ullrich et al. |
| 5,935,795 A | 8/1999 | Lin et al. |
| 5,968,479 A * | 10/1999 | Ito ............. A61K 49/0032 548/465 |
| 5,985,822 A | 11/1999 | Edelman et al. |
| 6,028,174 A | 2/2000 | Ullrich et al. |
| 6,130,101 A | 10/2000 | Mao et al. |
| 6,319,891 B1 | 11/2001 | Sontheimer et al. |
| 6,403,625 B1 | 6/2002 | Nagao et al. |
| 6,429,187 B1 | 8/2002 | Sontheimer et al. |
| 6,514,481 B1 | 2/2003 | Prasad et al. |
| 6,555,652 B1 | 4/2003 | Itoh et al. |
| 6,610,547 B1 | 8/2003 | Klaveness et al. |
| 6,667,156 B2 | 12/2003 | Lyons et al. |
| 6,767,635 B1 | 7/2004 | Bahr et al. |
| 6,849,714 B1 | 2/2005 | Bridon et al. |
| 6,870,029 B2 | 3/2005 | Sontheimer et al. |
| 6,926,896 B2 | 8/2005 | Bosslet et al. |
| 6,972,326 B2 | 12/2005 | Haugland et al. |
| 7,094,868 B2 | 8/2006 | Samoylova et al. |
| 7,252,998 B2 | 8/2007 | Skerra et al. |
| 7,462,446 B2 | 12/2008 | Zhang et al. |
| 7,678,759 B2 | 3/2010 | Sontheimer et al. |
| 7,904,868 B2 | 3/2011 | Feilchenfeld A. |
| 8,093,060 B2 | 1/2012 | Hamachi et al. |
| 8,227,439 B2 | 7/2012 | O'Neill et al. |
| 8,470,607 B2 | 6/2013 | Jacoby et al. |
| 8,778,310 B2 | 7/2014 | Zhang et al. |
| 8,945,553 B2 | 2/2015 | Stevens et al. |
| 9,018,347 B2 | 4/2015 | Sentissi |
| 9,944,683 B2 | 4/2018 | Olson |
| 10,822,381 B2 | 11/2020 | Olson |
| 2001/0007025 A1 | 7/2001 | Bennett et al. |
| 2002/0065216 A1 | 5/2002 | Sontheimer et al. |
| 2002/0146749 A1 | 10/2002 | Lyons PH.D et al. |
| 2003/0021810 A1 | 1/2003 | Sontheimer et al. |
| 2003/0031669 A1 | 2/2003 | Goldenberg |
| 2003/0113334 A1 | 6/2003 | Pero et al. |
| 2003/0201208 A1 | 10/2003 | Koch et al. |
| 2003/0216322 A1 | 11/2003 | Samoylova et al. |
| 2003/0232013 A1 | 12/2003 | Sieckman et al. |
| 2004/0101822 A1 | 5/2004 | Wiesner et al. |
| 2004/0102381 A1 | 5/2004 | Ekwuribe et al. |
| 2004/0105980 A1 | 6/2004 | Sudarshan et al. |
| 2004/0141981 A1 | 7/2004 | Sontheimer et al. |
| 2004/0180846 A1 | 9/2004 | Huang et al. |
| 2005/0142062 A1 | 6/2005 | Sontheimer et al. |
| 2005/0261191 A1 | 11/2005 | Barasch et al. |
| 2006/0019256 A1 | 1/2006 | Clarke et al. |
| 2006/0019347 A1 | 1/2006 | Cho et al. |
| 2006/0088899 A1 | 4/2006 | Alvarez et al. |
| 2006/0166892 A1 | 7/2006 | Alvarez et al. |
| 2007/0071764 A1 | 3/2007 | Sullivan et al. |
| 2007/0154965 A1 | 7/2007 | Zhang et al. |
| 2007/0237714 A1 | 10/2007 | Alvarez |
| 2007/0275902 A1 | 11/2007 | Gonda et al. |
| 2008/0153745 A1 | 6/2008 | Tian |
| 2008/0153746 A1 | 6/2008 | Alvarez et al. |
| 2008/0279780 A1 | 11/2008 | Zhang et al. |
| 2009/0004105 A1 | 1/2009 | Cheng et al. |
| 2009/0028788 A1 | 1/2009 | Achilefu |
| 2009/0123946 A1 | 5/2009 | Birkenmeyer et al. |
| 2009/0123970 A1 | 5/2009 | Tu et al. |
| 2009/0124022 A1 | 5/2009 | Birkenmeyer et al. |
| 2009/0142266 A1 | 6/2009 | Ronjat et al. |
| 2009/0176274 A1 | 7/2009 | Tu et al. |
| 2009/0203598 A1 | 8/2009 | McCarty et al. |
| 2009/0220430 A1 | 9/2009 | Rajopadhye et al. |
| 2009/0263894 A1 | 10/2009 | Birkenmeyer et al. |
| 2009/0269777 A1 | 10/2009 | Birkenmeyer et al. |
| 2009/0304592 A1 | 12/2009 | O'Neill et al. |
| 2009/0311224 A1 | 12/2009 | Lee et al. |
| 2009/0317334 A1 | 12/2009 | Okamoto et al. |
| 2010/0098637 A1 | 4/2010 | Orringer et al. |
| 2010/0105150 A1 | 4/2010 | Adamczyk et al. |
| 2010/0210546 A1 | 8/2010 | Alvarez et al. |
| 2010/0215575 A1 | 8/2010 | O'Neill et al. |
| 2010/0215576 A1 | 8/2010 | Sontheimer et al. |
| 2011/0027177 A1 | 2/2011 | Jacoby et al. |
| 2011/0055751 A1 | 3/2011 | Morrison et al. |
| 2011/0091380 A1 | 4/2011 | Jacoby et al. |
| 2011/0311445 A1 | 12/2011 | Alvarez et al. |
| 2012/0156131 A1 | 6/2012 | Alvarez |
| 2012/0183544 A1 | 7/2012 | Sontheimer et al. |
| 2013/0028836 A1 | 1/2013 | Sentissi et al. |
| 2013/0045163 A1 | 2/2013 | O'Neill et al. |
| 2013/0164220 A1 | 6/2013 | Yu et al. |
| 2013/0195760 A1 | 8/2013 | Olson |
| 2013/0280281 A1 | 10/2013 | Castaigne et al. |
| 2014/0179560 A1 | 6/2014 | Olson et al. |
| 2014/0241993 A1 | 8/2014 | Zhang et al. |
| 2015/0030537 A1 | 1/2015 | Sentissi et al. |
| 2015/0080721 A1 | 3/2015 | Novak et al. |
| 2015/0182596 A1 | 7/2015 | Lee et al. |
| 2016/0096869 A1 | 4/2016 | Hansen et al. |
| 2017/0304342 A1 | 10/2017 | Cox et al. |
| 2019/0117728 A1 | 4/2019 | Olson et al. |
| 2019/0282661 A1 | 9/2019 | Hansen et al. |

FOREIGN PATENT DOCUMENTS

| | | |
|---|---|---|
| CN | 101003788 A | 7/2007 |
| CN | 101270158 A | 9/2008 |
| CN | 101381405 A | 3/2009 |
| CN | 101824084 A | 9/2010 |
| CN | 101921769 A | 12/2010 |
| EP | 0155396 A2 | 9/1985 |
| EP | 0188256 A2 | 7/1986 |
| EP | 1430131 B1 | 11/2005 |
| EP | 2182004 A1 | 5/2010 |
| JP | H08505615 A | 6/1996 |
| JP | H08325291 A | 12/1996 |
| JP | H0971599 A | 3/1997 |
| JP | H09127115 A | 5/1997 |
| JP | 2009023993 A | 2/2009 |
| JP | 2010085108 A | 4/2010 |
| JP | 2013224283 A | 10/2013 |
| WO | WO-8802117 A1 | 3/1988 |
| WO | WO-9311222 A1 | 6/1993 |
| WO | WO-9415615 A1 | 7/1994 |
| WO | WO-9724619 A1 | 7/1997 |
| WO | WO-9802743 A1 | 1/1998 |
| WO | WO-0062807 A1 | 10/2000 |
| WO | WO-0062810 A1 | 10/2000 |
| WO | WO-0153342 A1 | 7/2001 |
| WO | WO-03000203 A2 | 1/2003 |
| WO | WO-03008583 A2 | 1/2003 |

(56) References Cited

FOREIGN PATENT DOCUMENTS

| WO | WO-03020751 A2 | 3/2003 | |
| --- | --- | --- | --- |
| WO | WO-03082196 A2 | 10/2003 | |
| WO | WO-03101474 A1 | 12/2003 | |
| WO | WO-03101475 A1 | 12/2003 | |
| WO | WO-2005002604 A1 | 1/2005 | |
| WO | WO-2005053611 A2 | 6/2005 | |
| WO | WO-2005099774 A2 | 10/2005 | |
| WO | WO-2005107793 A2 | 11/2005 | |
| WO | WO-2005099774 A3 | 3/2006 | |
| WO | WO-2006040574 A2 | 4/2006 | |
| WO | WO-2005053611 A3 | 5/2006 | |
| WO | WO-2006095164 A1 | 9/2006 | |
| WO | WO-2006110581 A2 | 10/2006 | |
| WO | WO-2006110582 A1 | 10/2006 | |
| WO | WO-2006115633 A2 | 11/2006 | |
| WO | WO-2006116156 A2 | 11/2006 | |
| WO | WO-2007038619 A2 | 4/2007 | |
| WO | WO-2007044994 A2 | 4/2007 | |
| WO | WO-2007047458 A2 | 4/2007 | |
| WO | WO-2007117467 A2 | 10/2007 | |
| WO | WO-2007137163 A2 | 11/2007 | |
| WO | WO-2007117467 A3 | 1/2008 | |
| WO | WO-2008063291 A2 | 5/2008 | |
| WO | WO-2008075968 A1 | 6/2008 | |
| WO | WO-2008088422 A2 | 7/2008 | |
| WO | WO-2008155134 A1 | 12/2008 | |
| WO | WO-2009021136 A1 | 2/2009 | |
| WO | WO-2009029760 A1 | 3/2009 | |
| WO | WO-2009049184 A2 | 4/2009 | |
| WO | WO-2009052390 A1 | 4/2009 | |
| WO | WO-2009052392 A1 | 4/2009 | |
| WO | WO-2009052400 A1 | 4/2009 | |
| WO | WO-2009062520 A1 | 5/2009 | |
| WO | WO-2009108762 A2 | 9/2009 | |
| WO | WO-2009114776 A2 | 9/2009 | |
| WO | WO-2009117018 A1 | 9/2009 | |
| WO | WO-2009133362 A2 | 11/2009 | |
| WO | WO-2009140599 A1 | 11/2009 | |
| WO | WO-2009156456 A1 | 12/2009 | |
| WO | WO-2010029760 A1 | 3/2010 | |
| WO | WO-2011057295 A2 | 5/2011 | |
| WO | WO-2011073340 A1 | 6/2011 | |
| WO | WO-2011094671 A2 | 8/2011 | |
| WO | WO-2011097533 A1 | 8/2011 | |
| WO | WO-2011142858 A2 * | 11/2011 | ......... A61K 47/6415 |
| WO | WO-2012022742 A1 | 2/2012 | |
| WO | WO-2012039741 A1 | 3/2012 | |
| WO | WO-2012064658 A1 | 5/2012 | |
| WO | WO-2013003507 A1 * | 1/2013 | ......... A61K 47/6415 |
| WO | WO-2013078250 A2 | 5/2013 | |
| WO | WO-2014013730 A1 | 1/2014 | |
| WO | WO-2014063012 A1 | 4/2014 | |
| WO | WO-2014093406 A1 | 6/2014 | |
| WO | WO-2014180534 A1 | 11/2014 | |
| WO | WO-2015013330 A2 | 1/2015 | |
| WO | WO-2015042202 A1 | 3/2015 | |
| WO | WO-2015075699 A1 | 5/2015 | |
| WO | WO-2015100370 A2 | 7/2015 | |
| WO | WO-2015179635 A2 | 11/2015 | |
| WO | WO-2016112176 A1 | 7/2016 | |
| WO | WO-2016112208 A2 | 7/2016 | |
| WO | WO-2016118859 A1 | 7/2016 | |
| WO | WO-2016210376 A2 | 12/2016 | |
| WO | WO-2017044894 A2 | 3/2017 | |
| WO | WO-2017100700 A2 | 6/2017 | |
| WO | 2017136769 A1 | 8/2017 | |
| WO | WO-2017143259 A1 | 8/2017 | |
| WO | WO-2018049285 A1 | 3/2018 | |
| WO | WO-2018119001 A1 | 6/2018 | |
| WO | WO-2018136614 A1 | 7/2018 | |
| WO | WO-2018170480 A1 | 9/2018 | |
| WO | WO-2018232122 A1 | 12/2018 | |
| WO | 2019055840 A1 | 3/2019 | |

OTHER PUBLICATIONS

Akabani, et al., "Dosimetry and Radiographic Analysis of 131I-Labeled Anti-tenascin 81C6 Murine Monoclonal Antibody in Newly Diagnosed Patients with Malignant Gliomas: a phase II study," J Nucl Med, Jun. 2005, vol. 46(6), pp. 1042-1051.

Akabani, et al., "Dosimetry of 131I-Labeled 81C6 Monoclonal Antibody Administered into Surgically Created Resection Cavities in Patients with Malignant Brain Tumors," J Nucl Med, Apr. 1999, vol. 40(4), pp. 631-638.

Akcan, et al., "Chemical Re-engineering of Chlorotoxin improves Bioconjugation Properties for Tumor Imaging and Targeted Therapy," J Med Chem, Feb. 2011, vol. 54(3), pp. 782-787, doi: 10.1021/jm101018r. Epub Jan. 6, 2011, 6 Pages.

Alander, et al., "A Review of Indocyanine Green Fluorescent Imaging in Surgery," Int J Biomed Imaging, 2012, 2012:940585, doi: 10.1155/2012/940585, Epub Apr. 22, 2012, 26 Pages.

Aldrich M.D., et al., "Concentration of Indocyanine Green Does Not Significantly Influence Lymphatic Function as Assessed by Near-Infrared Imaging," Lymphatic Research and Biology, 2012, vol. 10(1), 5 pages.

Amersham Biosciences, "CyDye Mono-reactive NHS Esters: Reagents for the Labelling of Biological Compounds with Cy Monofunctional Dyes," Amersham Biosciences, 2002, 20 pages.

Amersham Biosciences, "Labelling of Proteins with CyDye N-hydroxysuccinimide Esters for Fluorescent Applications on the LEADseeker Homogeneous Imaging System," Amersham Biosciences, Jan. 2001, (L8), 4 pages.

Appelbaum F.R., et al., "Treatment of Malignant Lymphoma in 100 Patients with Chemotherapy, Total Body Irradiation, and Marrow Transplantation," J Clin Oncol, Sep. 1987, vol. 5(9), pp. 1340-1347.

Ashitate Y., et al., "Endocrine-Specific NIR Fluorophores for Adrenal Gland Targeting," Chem Commun (Camb), Aug. 11, 2016, vol. 52(67), pp. 10305-10308, doi:10.1039/c6cc03845j.

Baker M., et al., "Effects of a Epithelial C1 Channel Blocker on Whole Cell Voltage Clamp and Patch Clamp Recordings from a Human Astrocytoma in Culture," Proceedings of the Physiological Society, J. Physiol, vol. 438, Feb. 15-16, 1991, 4 pages.

Banks W.A., et al., "Characteristics of Compounds that Cross the Blood-brain barrier," BMC Neurol, 2009, vol. 9(Suppl 1): S3, Published online Jun. 12, 2009, 5 pages, doi: 10.1186/1471-2377-9-S1-S3.

Banks W.A., et al., "Delta Sleep-inducing Peptide Crosses the Blood-brain-barrier in Dogs: Some Correlations with Protein Binding," Pharmacol Biochem Behav, Nov. 1982, vol. 17(5), pp. 1009-1014.

Berendsen, "Herman. A glimpse of the Holy Grail?," Science, Oct. 23, 1998, vol. 282, Issue. 5389, pp. 642-643.

Berezin, et al., "Rational Approach to Select Small Peptide Molecular Probes Labeled with Fluorescent Cyanine Dyes for in vivo Optical Imaging," Biochemistry, Apr. 5, 2011, vol. 50(13), pp. 2691-2700, doi: 10.1021/bi2000966, Epub Mar. 8, 2011.

Berge, et al., "Pharmaceutical Salts," Journal of Pharmaceutical Science, Jan. 1977, vol. 66, pp. 1-19.

Berlier J.E., et al., "Quantitative Comparison of Long-Wavelength Alexa Fluor Dyes to Cy Dyes: Fluorscence of the Dyes and Their Bioconjugates," The Journal of Histochemistry & Cytochemistry, Jul. 30, 2003, vol. 51(12), pp. 1699-1712.

Bertolini F., et al., "Inhibition of Angiogenesis and Induction of Endothelial and Tumor Cell Apoptosis by Green Tea in Animal Models of Human High-grade Non-Hodgkin's Lymphoma," Leukemia, Aug. 2000, vol. 14(8), pp. 1477-1482.

Bigner D.D., et al., "Iodine-131-Labeled Antitenascin Monoclonal Antibody 81C6 Treatment of Patients with Recurrent Malignant Gliomas: Phase I Trial Results," Journal of Clinical Oncology, Jun. 1998, vol. 16(6), pp. 2202-2012.

Blaze Bioscience and Fred Hutchinson Cancer Research Center Enter into Collaboration and Option Agreement in Support of Optides Discovery Program. Seattle, WA, On Jul. 3, 2013, Contact person: Julie Rathbun, 2 pages.

(56) References Cited

OTHER PUBLICATIONS

Blaze Bioscience Announces Initiation of First-in-Human Phase 1 Clinical Study of BLZ-100, In Seattle, WA and Melbourne, AU on Dec. 19, 2013, Contact person: Julie Rathburn, 2 pages.
Blaze Bioscience Announces Presentation at the 2014 Wedbush PacGrow Life Sciences Management Access Conference, In New York on Aug. 13, 2014, Contact person: Media-Lauren Nelson, 1 page.
Blaze Bioscience Announces Two Poster Presentations at AACR-SNMMI Conference and Award of NCI SBIR Contract Advancing Tumor PaintTM Technology, In Seattle, WA, On Feb. 27, 2013, Contact person: Julie Rathbun, 2 pages.
Blaze Bioscience Licenses Tumor Paint Technology from Fred Hutchinson Cancer Research Center. In Seattle, WA, On Oct. 18, 2011, Contact Person: Heather Franklin, 1 page.
Bodey B., et al., "Failure of Cancer Vaccines: The Significant Limitations of this Approach to Immunotherapy," Anticancer Res, Jul.-Aug. 2000, vol. 20(4), pp. 2665-2676.
Bowie, et al., "Deciphering the Message in Protein Sequences: Tolerance to Amino Acid Substitutions," Science, Mar. 16, 1990, vol. 47, Issue. 4948, pp. 1306-1310.
Bradley C.M., et al., "Limits of Cooperativity in a Structurally Modular Protein: Response of the Notch Ankyrin Domain to Analogous Alanine Substitutions in each Repeat," Journal of Molecular Biology, Nov. 22, 2002, vol. 324(2), pp. 373-386.
Brem H., et al., "Placebo-controlled Trial of Safety and Efficacy of Intraoperative Controlled Delivery by Biodegradable Polymers of Chemotherapy for Recurrent Gliomas," The Polymer-brain Tumor Treatment Group, Lancet, Apr. 22, 1995, vol. 345(8956), pp. 1008-1012.
Bremer, et al., "Protein Delivery with Infusion Pumps," In Protein Delivery: Physical Systems, Sanders and Hendren (eds.), 1977, pp. 239-254 (Plenum Press 1997).
Brismar T., et al., "Inward Rectifying Potassium Channels in Human Malignant Glioma Cells," Brain Research, Feb. 20, 1989, vol. 480(1-2), pp. 249-258.
Brismar T., et al., "Potassium and Sodium Channels in Human Malignant Glioma Cells," Brain Research, Feb. 20, 1989, vol. 480(1-2), pp. 259-267.
Britton K.E., et al., "Prostate Cancer: The Contribution of Nuclear Medicine," BJU International, Jul. 2000, vol. 86(s1), pp. 135-142.
Burger P.C., et al., "Topographic Anatomy and CT Correlations in the Untreated Glioblastoma Multiforme," J Neurosurg, May 1988, vol. 68 (5), pp. 698-704.
Burgess W H., et al., "Possible Dissociation of the Heparin-Binding and Mitogenic Activities of Heparin-Binding (Acidic Fibroblast) Growth Factor-1 from its Receptor-Binding Activities by Site-Directed Mutagenesis of a Single Lysine Residue," Journal of Cell Biology, Nov. 1990, vol. 111, pp. 2129-2138.
Buskens C., et al., "Adenocarcinomas of the Gastro-Esophageal Junction: A Comparative Study of the Gastric Cardia and the Esophagus with Respect to Cyclooxygenase-2 Expression," Abstract. 2003, Publishing ID: 850, Abstract ID: 101362. 1 page. Accessed on Jan. 28, 2004. URL: http://ddw03.agora.com/planner/displayabstract. asp?presentationid=11913.
Butterworth M.D., et al., "Preparation of Ultrafine Silica- and PEG-Coated Magnetite Particles," Colloids and Surfaces A: Physicochemical and Engineering Aspects, 2001, vol. 179, pp. 93-102.
Castro M.G., et al., "Gene Therapy for Parkinson's Disease: Recent Achievements and Remaining Challenges," Histol Histopathol, Oct. 2001, vol. 16 (4), pp. 1225-1238.
Cheng Y., et al., "Recent Advances in Diagnosis and Treatment of Gliomas using Chlorotoxin-based Bioconjugates," American Journal of Nuclear Medicine and Molecular Imaging, Aug. 2014, vol. 4 (5), pp. 385-405, eCollection 2014.
Chien C-T., et al., "The Two-hybrid System: A Method to Identify and Clone Genes for Proteins that Interact with a Protein of Interest," Proceedings of the National Academy of Sciences of the United States of America, Nov. 1, 1991, vol. 88 (21), pp. 9578-9582.

Chui S.Y., et al., "The Role of Potassium Channels in Schwann Cell Proliferation in Wallerian Degeneration of Explant Rabbit Sciatic Nerves," Journal of Physiology, Jan. 1989, vol. 408, pp. 199-222.
Chuthapisith S., et al., "Annexins in Human Breast Cancer: Possible Predictors of Pathological Response to Neoadjuvant Chemotherapy," European Journal of Cancer, May 2009, vol. 45 (7), pp. 1274-1281, doi: 10.1016/j.ejca.2008.12.026. Epub Jan. 24, 2009.
"Scifinder Cas# for Indocyanine Green," Printed from Web, Oct. 18, 2018, pp. 1-5.
Citrin D., et al., "In Vivo Tumor Imaging in Mice With Near-infrared Labeled Endostatin," Molecular Cancer Therapeutics, Apr. 2004, vol. 3 (4), pp. 481-488.
Colman P.M., "Effects of Amino Acid Sequence Changes on Antibody-antigen Interactions," Research in immunology, Jan. 1994, vol. 145 (1), pp. 33-36.
Co-pending U.S. Appl. No. 16/706,585, inventors Hansen Stacey; J. et al., filed on Dec. 6, 2019.
Cui., "Structural Analysis of Polysaccharides. Chapter 3," Copyright 2005 by Taylor & Francis Group, LLC.
"Custom Peptide Synthesis: Designing Custom Peptides," SIGMA GENOSYS, 2004, 2 Pages.
"CyDye TM Mono-Reactive NHS-Esters," Amersham Biosciences, 2002, pp. 1-20.
Daly J.W., et al., "Pumiliotoxin Alkaloids: A New Class of Sodium Channel Agents," Abstract of Biochem Pharmacol, Jul. 15, 1990, vol. 40 (2), pp. 315-326.
Database Geneseq [Online] Oct. 16, 2008 (Oct. 16,, 2008), "Alpha-scorpion Toxin Family Member CTX Toxin Peptide Analog, SEQ:473," XP002714000, retrieved from EBI accession No. GSP:ATD17606 Database accession No. ATD17606 * sequence.
Davis, C., "The Many Faces of Epidermal Growth Factor Repeats," New Biology, May 1990, vol. 2(5), pp. 410-409.
Davis, R., "Treating Kids' Cancer With Science And A Pocket Full Of Hope," Joe's Big Idea,Sep. 13, 2013, 17 pgaes.
Davis, R., "Why Painting Tumors Could Make Brain Surgeons Better," Joe's Big Idea. Sep. 12, 2013, 14 pages.
De Muralt., et al., "Reactivity of Antiglioma Monoclonal Antibodies for a Large Panel of Cultured Gliomas and other Neuroectoderm Derived Tumors," Anticancer Res, Jan.-Feb. 1983, vol. 3(1), pp. 1-6.
Deane, O et al., "An Alternative Pathway of B Cell Activation: Stilbene Disulfonates Interact with a Cl- binding Motif on AEn-related Proteins to Stimulate Mitogenesis," European Journal of Immunology, May 1, 1992, vol. 22 (5), pp. 1165-1171.
Debin J. A., et al., "Chloride Channel Inhibition by the Venom of the Scorpion Leiurus Quinquestriatus," Toxicon, 1991, vol. 29 (11), pp. 1403-1408.
Debin J. A., et al., "Purification and Characterization of Chlorotoxin, A Chloride Channel Ligand from the Venom of the Scorpion," American Journal of Physiology, Feb. 1993, vol. 264 (2 Pt 1), pp. C361-C369.
Dermer G.B., et al., "Another Anniversary for the War on Cancer," Nature Biotechnology 12, Mar. 1, 1994, vol. 320, doi:10.1038/nbt0394-320.
Dernell W.S., et al., "Principles of Treatment for Soft-tissue Sarcoma," Clinical Techniques in Small Animal Practice, Feb. 1998, vol. 13(1), pp. 59-64.
Dernell W.S., et al., "Tumor Paint Technology Detects Naturally Occurring Solid Tumors in Dod," In Proceedings of the 105th Annual Meeting of the American Association for Cancer Research, Apr. 5-9, 2014; vol. 74 (19 Suppl), 1 Page, Abstract # 4936, doi:10.1158/1538-7445.AM2014-4936.
Deroose J.P., et al., "Radiotherapy for Soft-tissue Sarcomas after Isolated Limb Perfusion and Surgical Resection: Essential for local control in all patients?," Annals of Surgical Oncology, Feb. 2011, vol. 18 (2), pp. 321-327, doi: 10.1245/s10434-010-1400-x. Epub Nov. 4, 2010.
Deshane J., et al., "Chlorotoxin Inhibits Glioma Cell Invasion via Matrix Metalloproteinase-2," The Journal of Biological Chemistry, Feb. 7, 2003, vol. 278, No. 6, pp. 4135-4144, Epub Nov. 25, 2002, XP002398052, DOI: 1074/jbc.M205662200.
Dibiase M.D., et al., "Oral Delivery of Microencapsulated Proteins," Pharmaceutical biotechnology, 1997, vol. 10, pp. 255-288.

(56) References Cited

OTHER PUBLICATIONS

Dictionary.Com, Definition of the Word "Moiety," pp. 1-3, Retrived from URL: http://dictionary.reference.com/browse/moiety. (last accessed Aug. 26, 2010).
Drexler H.G., et al., "Recent Results on the Biology of Hodgkin and Reed-Sternberg cells. II. Continuous cell lines," Leuk Lymphoma, Jan. 1993, vol. 9 (1-2), pp. 1-25.
Eck, et al., "Gene-Based Therapy. Chapters," Goodman & Gilman's The Pharmacological Basis of Therapeutics. 9th Edition, pp. 77-101.
Egleton R.D., et al., "Development of Neuropeptide Drugs that Cross the Blood-Brain Barrier," J. Am. Soc. Exp. NeuroTherapeutics, Jan. 2005, vol. 2, pp. 44-53.
Entrez Genome. ANXA2 annexin A2 [homo sapiens]. Gene ID: 302, updated on Aug. 26, 2010. Retrieved on Sep. 7, 2010. URL: http://www.ncbi.nlm.nih.gov/gene/302.
Epstein M.A., et al., "Morphological and Virological Investigations on Cultured Burkitt Tumor Lymphoblasts (strain Raji)," Journal of the National Cancer Institute, Oct. 1966, vol. 37, Issue. 4, pp. 547-559.
European search report and search opinion dated Oct. 15, 2013 for EP Application No. 11780950.9., 12 pages.
Evans B.E., et al., "Design of Nonpeptidal Ligands for a Peptide Receptor: Cholecystokinin Antagonists," Journal of Medicinal Chemistry, Jul. 1987, vol. 30 (7), pp. 1229-1239.
Extended European Search Report and Search Opinion dated May 29, 2017 for European Patent Application No. EP14846407.6, 11 pages.
Extended European Search Report dated Apr. 6, 2010 for European Patent Application No. EP09176234.4, 9 pages.
Extended European Search Report dated Nov. 23, 2010 for European Patent Application No. EP08837002.8, 9 pages.
Extended European Search Report dated Jul. 30, 2010 for European Patent Application No. EP09150772.3, 18 pages.
Fauchere., Jean-Luc. "Elements for the Rational Design of Peptide Drugs," Advances in Drug Research, vol. 15, Academic Press, 1986, pp. 29-69.
Fields S., et al., "A Novel Genetic System to Detect Protein-protein Interactions," Letters to Nature. Nature, vol. 340, (Jul. 20, 1989), pp. 245-246, doi:10.1038/340245a0.
Fischer G.M., et al., "Pyrrolopyrrole Cyanine Dyes: A New Class of Near-infrared Dyes and Fluorophores," Chemistry, 2009, vol. 15, Issue. 19, pp. 4857-4864, doi:10.1002/chem.200801996.
Fiveash J.B., et al., "Safety and Tolerance of Multiple Weekly Intracavitary Injections of 131I-chlorotoxin (TM-601): Preliminary Results of a Prospective Clinical Trial in Patients with Recurrent Glioblastoma Multiforme," Poster. Journal of Clinical Oncology, 2006 ASCO Annual Meeting Proceedings. Abstact No. 1555. 1 page.
Fiveash J.B., et al., "Tumor Specific Targeting of Intravenous 131I-chlorotoxin (TM-601) in Patients With Recurrent Glioma," International Journal of Radiation Oncology, ASTRO. Nov. 1, 2007, vol. 69, Issue. 3, Supplement, pp. S257-S258.
Flower D.R., et al., "Structure and Sequence Relationships in the Lipocalins and Related Proteins," Protein Science, May 1993, vol. 2, Issue. 5, pp. 753-761.
Freshney, R. I., "Culture of Animal Cells: A Manual of Basic Technique," A.R. Liss, 1983, 4 pages.
Friedman H S., et al., "Temozolomide and Treatment of Malignant Glioma," Clinical Cancer Research. Jul. 2000, vol. 6, Issue. 7, pp. 2585-2597.
Goetz D.H., et al., "The Neutrophil Lipocalin NGAL is a Bacteriostatic Agent that Interferes with Siderophore-mediated Iron Acquisition," Mol Cell. Nov. 2002, vol. 10, Issue. 5, p. 1033-43, 11 Pages.
Goldstein G.W., et al., "The Blood-brain Barrier," Sci Am. Sep. 1986, vol. 255, Issue. 3, pp. 74-83, 12 Pages.
Gordon I., et al., "The Comparative Oncology Trials Consortium: Using spontaneously occurring cancers in dogs to inform the cancer drug development pathway," PLoS Med, Oct. 2009, vol. 6, Issue. 10, e1000161. doi: 10.1371/journal.pmed.1000161. Epub Oct. 13, 2009, 5 Pages.

Gorecki, et al., "Prospects and Problems of Gene Therapy: An Update," Expert Opin Emerg Drugs, Oct. 2001, vol. 6 (2), pp. 187-198.
Gorman, et al., "The Hope and the Hype," Time, May 18, 1998, vol. 151, Issue. 19, pp. 40-44, 7 Pages.
Gray P.T.A., et al., "A Voltage-gated Chloride Conductance in Rat Cultured Astrocytes," Proc R Soc Lond B Biol Sci, Aug. 22, 1986, vol. 228, Issue. 1252, pp. 267-288, 23 Pages.
Griffith C., "One Doctor's Quest to Save People by Injecting Them With Scorpion Venom," Brendan I. Koerner Science, Jun. 24, 2014, 17 Pages.
Grimes C.A., et al., "TM-601 Targets Human Cancer Cells via a Phosphatidylinositol Phosphate in Lamellipodia," J. Clin. Oncol., ASCO Annual Meeting Proceedings Part I, Abstract 9556 (Jun. 2005), 4 Pages.
Grissimer S., et al., "Calcium-activated Potassium Channels in Resting and Activated Human T lymphocytes. Expression levels, calcium dependence, ion selectivity, and pharmacology," J Gen Physiol, Oct. 1993, vol. 102, Issue. 4, pp. 601-630, 30 Pages.
Grossman S.A., et al., "Current Management of Glioblastoma Multiforme," Semin Oncol, Oct. 2004, vol. 31, Issue. 5, pp. 635-644, 10 Pages.
Gunn J., et al., "Smart Superparamagnetic Imaging Probes for Brain Tumor Research, in D.B. Baer and C.T. Campbell (eds.)," Joint Institute for Nanoscience Annual Report, 2004, Nov. 2005, pp. 3.65-3.66, 5 Pages.
Gura T., et al., "Systems for Identifying New Drugs are Often Faulty," Science, Nov. 7, 1997, vol. 278, Issue. 5340, pp. 1041-1042, 2 Pages.
Hajjar, et al., "Annexin II: A Mediator of the Plasmin/Plasminogen Activator System," Trends in Cardiovascular Medicine. Jul. 1999, vol. 9 (5), pp. 128-138.
Hansen S., et al., "Evaluation of Candidate Near-infrared Dyes for Clinical Translation of Tumor Paint Technology," Abstract # 71, AACR/SNMMI State-of-the-Art Molecular Imaging in Cancer Biology and Therapy, Feb. 27-Mar. 2, 2013, in San Diego, California, 1Page.
Hargis A.M., et al., "Animal Model: Solar Dermatosis (keratosis) and Solar Dermatosis with Squamous Cell Carcinoma," Am J Pathol, Jan. 1979, vol. 94, Issue. 1, pp. 193-196, 4 Pages.
Hartwell L.H., et al., "Integrating Genetic Approaches into the Discovery of Anticancer Drugs," Science, Nov. 7, 1997, vol. 278, Issue. 5340, pp. 1064-1068.
Hatton B.A., et al., "The Smo/Smo model: Hedgehog-induced Medulloblastoma with 90% Incidence and Leptomeningeal Spread," Cancer Res, Mar. 15, 2008, vol. 68,(6), pp. 1768-1776, doi: 10.1158/0008-5472.CAN-07-5092.
He L., et al., "A Simple and Effective "Capping" Approach to Readily Tune the Fluorescence of Near-infrared Cyanines," Chemical Science., Jan. 29, 2015, vol. 6 (8), pp. 4530-4536.
Hinchcliffe M., et al., "Intranasal Insulin Delivery and Therapy," Adv Drug Deliv Rev, Feb. 1, 1999, vol. 35 (2-3), pp. 199-234, 36 Pages.
Hirata T., et al., "Synthesis and Reactivities of 3-lndocyanine-green-acyl-1,3- Thiazolidine-2-Thione (ICG-ATT) as a New Near-Infrared Fluorescent-Labeling Reagent," Bio-organic & Medicinal Chemistry, Nov. 1998, vol. 6, pp. 2179-2184, 6 Pages.
Holmes K.L., et al., "Protein Labeling with Fluorescent Probes," Methods Cell Biol, 2001, vol. 63, pp. 185-204, 20 Pages.
Holsi E., et al., "Evidence for GABAb-Receptors on Cultured Astrocytes of Rat CNS; Autoradiographic Binding Studies," Experimental Brain Reserach, 1990, vol. 80, pp. 621-625, 5 Pages.
Holt D., et al., "Intraoperative Near-Infrared Imaging can Distinguish Cancer from Normal Tissue but not Inflammation," PLoS One, Jul. 29, 2014, vol. 9 (7), e103342, 11 Pages.
Huang A., "Bright Idea: Making the Case for 'Tumor Paint' Blaze Bioscience's Brilliant Concept in the Fight Against Cancer," Print Edition, Sep. 2012, 2 Pages.
Huang Y., et al., "Potassium Channel Induction by the Ras/Raf Signal Transduction Cascade," J Biol Chem, Dec. 9, 1994, vol. 269 (49), pp. 31183-31189, 7 Pages.

(56) References Cited

OTHER PUBLICATIONS

Huys I., et al., "Structure-Function Study of a Chlorotoxin-Chimer and its Activity on Kv1.3 Channels," J Chromatogr B Analyt Technol Biomed Life Sci, Apr. 15, 2004, vol. 803 (1), pp. 67-73, 7 Pages.
Ibragimova G.T., et al., "Stability of the Beta-Sheet of the WW Domain: A Molecular Dynamics Simulation Study," Biophys J, Oct. 1999, vol. 77 (4), pp. 2191-2198, 8 Pages.
International Preliminary Examination Report for International PCT Patent Application No. PCT/US2000/010453, dated May 29, 2001, 4 Pages.
International Preliminary Report on Patentability for International PCT Patent Application No. PCT/2007/008309, dated Sep. 30, 2008, 9 Pages.
International Preliminary Report on Patentability for International PCT Patent Application No. PCT/US2004/039325, dated May 29, 2006, 4 pages.
International Preliminary Report on Patentability for International PCT Patent Application No. PCT/US2005/011523, dated Oct. 11, 2006, 7 pages.
International Preliminary Report on Patentability for International PCT Patent Application No. PCT/US2008/076740, dated Sep. 30, 2010, 7 pages.
International Preliminary Report on Patentability for International PCT Patent Application No. PCT/US2008/079547, dated Apr. 13, 2010, 4 pages.
International Preliminary Report on Patentability for International PCT Patent Application No. PCT/US2009/044149, dated Dec. 25, 2010, 5 pages.
International Search Report and Written Opinion for Application No. PCT/US2006/010170, dated Oct. 6, 2010, 13 pages.
International Search Report and Written Opinion for Application No. PCT/US2011/023797, dated Nov. 18, 2011, 11 pages.
International Search Report and Written Opinion for Application No. PCT/US2013/074215, dated Apr. 8, 2014, 11 pages.
International Search Report and Written Opinion for Application No. PCT/US2013/074218, dated Apr. 22, 2014, 15 pages.
International Search Report and Written Opinion for International PCT Patent Application No. PCT/US2004/039325, dated Mar. 27, 2006, 4 pages.
International Search Report and Written Opinion for International PCT Patent Application No. PCT/US2005/011523, dated Feb. 9, 2006, 8 pages.
International Search Report and Written Opinion for International PCT Patent Application No. PCT/US2007/008309, dated Nov. 20, 2007, 12 pages.
International Search Report and Written Opinion for International PCT Patent Application No. PCT/US2008/076740, dated Jan. 9, 2009, 8 pages.
International Search Report and Written Opinion for International PCT Patent Application No. PCT/US2009/044149, dated Oct. 19, 2009, 12 pages.
International Search Report and Written Opinion for PCT Application No. PCT/US2014/056177, dated Feb. 10, 2015, 17 pages.
International Search Report for International PCT Patent Application No. PCT/US1996/020403, dated May 7, 1996, 4 pages.
International Search Report for International PCT Patent Application No. PCT/US2003/017410, dated Nov. 13, 2003, 4 pages.
Jacoby D.B., et al., "Potent Pleiotropic Anti-Angiogenic Effects of TM601, a Synthetic Chlorotoxin Peptide," Anticancer Res, Jan. 2010, vol. 30 (1), pp. 39-46.
Jalonen T., "Single-Channel Characteristics of the Large-Conductance Anion Channel in Rat Cortical Astrocytes in Primary Culture," Glia, Nov. 1993, vol. 9(3), pp. 227-237.
Jiang T., et al., "Tumor Imaging by Means of Proteolytic Activation of Cell-Penetrating Peptides," Proceedings of the National Academy of Sciences USA (PNAS), Dec. 2004, vol. 101 (51), pp. 17867-17872.
Kaiser J., "First Pass at Cancer Genome Reveals Complex Landscape," Science, Sep. 8, 2006, vol. 313 (5792), pp. 1370.
Kastin A.J., et al., "Orexin A but not Orexin B Rapidly Enters Brain from Blood by Simple Diffusion," J Pharmacol Exp Ther, Apr. 1999, vol. 289 (1), pp. 219-223.
Kaye F.J., et al., "A Single Amino Acid Substitution Results in a Retinoblastoma Protein Defective in Phosphorylation and Oncoprotein Binding," Proceedings of the National Academy of Sciences of the United States of America, Sep. 1990, vol. 87 (17), pp. 6922-6926.
Kennedy K., et al., "Tumor Paint Technology Detects Naturally Occurring Solid Tumors in Dogs," Presentation No. P 578, The Sixth Annual World Molecular Imaging Congress, Sep. 18-21, 2013, Savannah, USA, 1 pages.
Kesavan, et al., "Annexin A2 is a Molecular Target for TM601, a Peptide with Tumor-Targeting and Anti-Angiogenic Effects," J Biol Chem, Feb. 12, 2010, vol. 285 (7), pp. 4366-4374.
Kessler, et al., "Identification of the Putative Brain Tumor Antigen BF7/GE2 as the (de)Toxifying Enzyme Microsomal Epoxide Hydrolase," Cancer Res, Mar. 1, 2000, vol. 60 (5), pp. 1403-1409.
Kimura R.H., et al., "A Dual-Labeled Knottin Peptide for PET and Near-Infrared Fluorescence Imaging of Integrin Expression in Living Subjects," Bioconjug Chem, Mar. 17, 2010, vol. 21 (3), pp. 436-444.
Kirkin A.F., et al., "Melanoma-Associated Antigens Recognized by Cytotoxic T Lymphocytes," APMIS, Jul. 1998, vol. 106 (7), pp. 665-679.
Klein M.T., et al., "Surface IgM-Kappa Specificity on a Burkitt Lymphoma Cell in Vivo and in Derived Culture Lines," Cancer Research, Jul. 1968, vol. 28(7), pp. 1300-1310.
Kohler N., et al., "A Bifunctional Poly(ethylene glycol) Silane Immobilized on Metallic Oxide-Based Nanoparticles for Conjugation with Cell Targeting Agents," Journal of the American Chemical Society, Jun. 16, 2004, vol. 126(23), pp. 7206-7211.
Kraft J.C., et al., "Interactions of Indocyanine Green and Lipid in Enhancing Near-Infrared Fluorescence Properties: The Basis for Near-Infrared Imaging in Vivo," Biochemistry, Mar. 4, 2014, vol. 53(8), pp. 1275-1283.
Kuan C-T., et al., "EGFRvIII as a Promising Target for Antibody-Based Brain Tumor Therapy,"Brain Tumor Pathology, 2000, vol. 17(2), pp. 71-78.
Kunwar, et al., "Cytotoxicity and Antitumor Effects of Growth Factor-Toxin Fusion Proteins on Human Glioblastoma Multiforme Cells," J Neurosurg, Oct. 1993, vol. 79 (4), pp. 569-576.
Laumonnier Y., et al., "Identification of the Annexin A2 Heterotetramer as a Receptor for the Plasmin-Induced Signaling in Human Peripheral Monocytes," Blood, 2006, vol. 107, pp. 3342-3349.
Lazar E., et al., "Transforming Growth Factor Alpha: Mutation of Aspartic Acid 47 and Leucine 48 Results in Different Biological Activities," Molecular and Cellular Biology, Mar. 1988, vol. 8(3), pp. 1247-1252.
Lee M.J., et al., "Rapid Pharmacokinetic and Biodistribution Studies Using Cholorotoxin-Conjugated Iron Oxide Nanoparticles: A Novel Non-Radioactive Method," PLoS One, Mar. 2010, vol. 5(3), pp. e9536 1-8.
Lee Y.Y., et al., "Increased Vaccine-Specific T Cell Frequency After Peptide-Based Vaccination Correlates with Increased Susceptibility to in Vitro Stimulation but does not Lead to Tumor Regression," The Journal of Immunolog, Dec. 1, 1999, vol. 163(11), pp. 6292-6300.
Lerman R., "Armed with a Poisonous Scorpion and Glowing Tumor Paint, Blaze Bioscience takes on cancer," Puget Sound Business Journal, Jul. 9, 2014, 4 pages.
Levin V.A., "The Place of Hydroxyurea in the Treatment of Primary Brain Tumors," Seminars in Oncology, 1992, vol. 19(3), pp. 34-39.
Licha K., et al., "Hydrophilic Cyanine Dyes as Contrast Agents for Near-Infrared Tumor Imaging: Synthesis, Photophysical Properties and Spectroscopic in Vivo Characterization," Photochemical Photobiol, Sep. 2000, vol. 72(3), pp. 392-398.
Lippens G., et al., "NMR Sequential Assignments and Solution Structure of Chlorotoxin, a Small Scorpion Toxin that Blocks Chloride Channels," Biochemistry, Jan. 10, 1995, vol. 34(1), pp. 13-21.
Lumiprobe, https://www.lumiprobe.com/tech/cyanine-dyes (obtained from website on May 21, 2021 (Year: 2021).
Lynch P.M., "Chemoprevention with Special Reference to Inherited Colorectal Cancer," Familial Cancer, 2008, vol. 7 (1), pp. 59-64.

(56) References Cited

OTHER PUBLICATIONS

Lyons S.A., et al., "Chlorotoxin, A Scorpion-Derived Peptide, Specifically Binds to Gliomas and Tumors of Neuroectodermal Origin," Glia, Aug. 2002, vol. 39 (2), pp. 162-173.
Malinowska D.H., et al., "Recombinant Chlorotoxin: An Inhibitor of Gastric Cl-Channels," Biophysical Journal, 1994, vol. 66 (2): p. A100.
Mamelak A.N., et al., "Phase 1/11 Trial of Intracavitary 131I-TM-601 in Adult Patients with Recurrent High-Grade Glioma," Astract from the Society for Neuro-Oncology Eighth Annual Meeting online, Oct. 2003, vol. 5, p. 340.
Mamelak A.N., et al., "Targeted Delivery of Antitumoral Therapy to Glioma and Other Malignancies with Synthetic Chlorotoxin (TM-601)," Expert Opinion on Drug Delivery, Mar. 2007, vol. 4(2), pp. 175-186.
Marshall M.V., et al., "Near-Infrared Fluorescence Imaging in Humans with Indocyanine Green: A Review and Update," Open Surgical Oncology Journal, 2010, vol. 2 (2), pp. 12-25.
McFerrin M.B., et al., "A Role for Ion Channels in Glioma Cell Invasion," Neuron Glia Biol, Feb. 2006, vol. 2(1), pp. 39-49.
McKie R., "Cancer Research Set Back a Decade: Mislabelling of Samples so Common that New Treatments have been Wrecked, Warn Scientists," The Observer, Jun. 10, 2001, 4 pages.
McMichael A.J., et al., "Leukocyte Typing III," Oxford University Press, 1987, pp. 302-363 and pp. 432-469.
Mellman I., Where Next for Cancer Immunotherapy? The Scientist, 2006, vol. 20 (1), pp. 47-56.
Merck., "Chemotherapy: Prevention and Treatment of Cancer," Merck Manual Home Edition, online manual, entry 'methotrexate'. 4 pages. URL: http://www.merck.com/rnmhe/print/sec15/ch182/ch182f.html.
Milross C.J., et al., "Relationship of Mitotic Arrest and Apoptosis to Antitumor Effect of Paclitaxel," Journal of the National Cancer Institute, Sep. 18, 1996, vol. 88 (18), pp. 1308-1314.
Minowada J., et al., "Rosette-Forming Human Lymphoid Cell Lines. I. Establishment and Evidence for Origin of Thymus-Derived Lymphocytes," Journal of the National Cancer Institute, Sep. 1972, vol. 49 (3), pp. 891-895.
Mizrahi D M., et al., "Synthesis, Fluorescence and Biodistribution of a Bone-Targeted NearInfrared Conjugate," European Journal of Medicinal Chemistry, Oct. 2011, vol. 46 (10), pp. 5175-5183.
Motta L., et al., "Canine and Feline Intracranial Meningiomas: An Updated Review," The Veterinary Journal, May 2012, vol. 192 (2), pp. 153-165.
Mousa S., et al., "Potent Anti-Angiogenesis Efficacy of Chlorotoxin and its Synergistic Interactions with Anti-VEGF Targets," American Association for Cancer Research Annual Meeting Proceedings, Abstract #268, 2008, 1 page.
Munz B., et al., "Differential Expression of the Calpactin I Subunits Annexin II and p11 in Cultured Keratinocytes and During Wound Repair," The Journal of Investigative Dermatology, Mar. 1997, vol. 108(3), pp. 307-312.
Muro K., et al., "Convection-Enhanced and Local Delivery of Targeted Cytotoxins in the Treatment of Malignant Gliomas," Technology in Cancer Research and Treatment, Jun. 2006, vol. 5(3), pp. 201-213.
Newlands E.S., et al., "Temozolomide: A Review of its Discovery, Chemical Properties, Pre-Clinical Development and Clinical Trials," Cancer Treatment Reviews, Jan. 1997, vol. 23(1), pp. 35-61.
Ngo J.T., et al., "Computational Complexity, Protein Structure Prediction, and the Levinthal Paradox," The Protein Folding Problem and Tertiary Structure Prediction, 1994, pp. 433-506.
Nolting D.D., et al., "Molecular Imaging Probe Development: A Chemistry Perspective," American Journal of Nuclear Medicine and Molecular Imaging, Jul. 10, 2012, vol. 2(3), pp. 273-306.
Nolting D.D., et al., "Near-Infrared Dyes: Probe Development and Applications in Optical Molecular Imaging," Current Organic Synthesis, Aug. 2011, vol. 8(4), pp. 521-534.
Ogawa M., et al., "In Vivo Molecular Imaging of Cancer with a Quenching Near-Infrared Fluorescent Probe Using Conjugates of Monoclonal Antibodies and Indocyanine Green," Cancer Research, Feb. 15, 2009, vol. 69(4), pp. 1268-1272.
Ohnishi S., et al., "Organic Alternatives to Quantum Dots for Intraoperative Near-Infrared Fluorescent Sentinel Lymph Node Mapping," Molecular Imaging, Jul. 1, 2005, vol. 4(3), pp. 172-181.
Ojeda P.G., et al., "The Role of Disulfide Bonds in Structure and Activity of Chlorotoxin," Future Medicinal Chemistry, Oct. 2014, vol. 6(15), pp. 1617-1628.
O'Neill A., et al., "Treatment of Metastatic Tumors," U.S. Appl. No. 61/053,651, filed May 15, 2008.
Pappas C.A., et al., "Reduction of Glial Proliferation by K+ Channel Blockers is Mediated by Changes in pHi," NeuroReport, Dec. 30, 1994, vol. 6(1), pp. 193-196.
Pappone P.A., et al., "Blockers of Voltage-Gated K Channels Inhibit Proliferation of Cultured Brown Fat Cells," American Journal of Physiology, Apr. 1993, vol. 264(4 Pt 1), pp. C1014-C1019.
Partial European Search Report for European Patent Application No. EP09150772.3, dated Aug. 4, 2010.
Parungo C.P., et al., "Intraoperative Identification of Esophageal Sentinel Lymph Nodes with Near-Infrared Fluorescence Imaging," Journal of Thoracic and Cardiovascular Surgery, Apr. 2005, vol. 129(4), pp. 844-850.
Patton J.S., et al., "Inhaled Insulin," Advanced Drug Delivery Reviews, Feb. 1, 1999, vol. 35(2-3), pp. 235-247.
Pettit D.K., et al., "The Development of Site-Specific Drug-Delivery Systems for Protein and Peptide Biopharmaceuticals," Trends in Biotechnology, Aug. 1998, vol. 16(8), pp. 343-349.
Phillips P.C., et al., "Transforming Growth Factor-Alpha-Pseudomonas Exotoxin Fusion Protein (TGF-alpha-PE38) Treatment of Subcutaneous and Intracranial Human Glioma and Medulloblastoma Xenografts in Athymic Mice," Cancer Research, Feb. 15, 1994, vol. 54(4), pp. 1008-1015.
Puro D.G., et al., "Retinal Glial Cell Proliferation and Ion Channels: A Possible Link," Investigative Ophthalmology & Visual Science, Mar. 1989, vol. 30(3), pp. 521-529.
Ramakrishnan S., et al., "Targeting Tumor Vasculature Using VEGF-Toxin Conjugates," Methods in Molecular Biology, 2001, vol. 166, pp. 219-234.
Ranade V.V., "Drug Delivery Systems: Implants in Drug Delivery," Journal of Clinical Pharmacology, 1990, vol. 30, pp. 871-879.
Ravic M., "Intracavitary Treatment of Malignant Gliomas: Radioimmunotherapy Targeting Fibronectin," Acta Neurochirurgica, Feb. 2003, vol. 88, pp. 77-82.
Rawstron, et al., "Quantitation of Minimal Disease Levels in Chronic Lymphocytic Leukemia Using a Sensitive Flow Cytometric Assay Improves the Prediction of Outcome and can be Used to Optimize Therapy Blood," Jul. 1, 2001, vol. 981, pp. 29-35.
Reardon D.A., et al., "A Pilot Study: 131l-Antitenascin Monoclonal Antibody 81c6 To Deliver A 44-Gy Resection Cavity Boost," Neuro-Oncology, Apr. 2008, vol. 10(2), pp. 182-189.
Reardon D.A., et al., "Phase II Trial of Murine (131)l-Labeled Antitenascin Monoclonal Antibody 81C6 Administered Into Surgically Created Resection Cavities of Patients With Newly Diagnosed Malignant Gliomas," Journal of Clinical Oncology, Mar. 1, 2002, vol. 20(5), pp. 1389-1397.
Rescher, et al., "Annexins-Unique Membrane Binding Proteins With Diverse Functions," Journal of Cell Science, Jun. 1, 2004, vol. 117 (13), pp. 2631-2639.
Ricotti E., et al., "C-Kit is Expressed in Soft Tissue Sarcoma of Neuroectodermic Origin and its Ligand Prevents Apoptosis of Neoplastic Cells," Blood, Apr. 1, 1998, vol. 91(7), pp. 2397-2405.
Robinson W.L., "The Role of The Pathologists In The Diagnosis of Cancer," The Canadian Medical Association Journal, Sep. 1934, vol. 31(3), pp. 298-301.
Rousselle C., et al., "New Advances in The Transport of Doxorubicin Through The Blood-Brain Barrier by a Peptide Vector-Mediated Strategy," Molecular Pharmacology, Apr. 2000, vol. 57(4), pp. 679-686.
Rudikoff S., et al., "Single Amino Acid Substitution Altering Antigen-Binding Specificity" Proceedings of the National Academy of Sciences of the United States of America, Mar. 1982, vol. 79(6), pp. 1979-1983.

(56) References Cited

OTHER PUBLICATIONS

Rudinger J., "Characteristics of the amino acids as components of a peptide hormone sequence," Journal of Peptide Hormones, J.A. Parsons, Ed., 1976, 8 pages.
Sakamoto H., et al., "Identification of A New Outwardly Rectifying CI- Channel That Belongs To A Subfamily of The CIc CI- Channels"Journal of Biological Chemistry., Apr. 26, 1996, vol. 271 (17), pp. 10210-10216.
Sano K., et al., "Short Peg-linkers Improve the Performance of Targeted, Activatable Monoclonal Antibody-indocyanine Green Optical Imaging Probes," Bioconjugate Chemistry, May 15, 2013, vol. 24 (5), pp. 811-816, Doi:10.1021/Bc400050K.
Schaafsma., et al., "The Clinical Use of Indocyanine Green As A Near-Infrared Fluorescent Contrast Agent for Image-Guided Oncologic Surgery," J Surg Oncol, Sep. 1, 2011, vol. 104 (3), pp. 323-332.
Sgouros G., "Bone Marrow Dosimetry for Radioimmunotherapy: Theoretical Considerations," The Journal of Nuclear Medicine, Apr. 1993, vol. 34 (4), pp. 689-694.
Sharma M.C., et al., "The Role of Annexin II In Angiogenesis and Tumor Progression: A Potential Therapeutic Target," Current Pharmaceutical Design, 2007, vol. 13 (35), pp. 3568-3575.
Shen, et al., "Patient-Specific Dosimetry of Pretargeted Radioimmunotherapy Using Cc49 Fusion Protein In Patients With Gastrointestinal Malignancies," The Journal of Nuclear Medicine, Apr. 2005, vol. 46 (4), pp. 642-651.
Shen S., et al., "Dosimetry of Phase I/li Study of Intracavitary Administered 1-131-Tm-601 Peptide In Patients With Recurrent High-Grade Glioma," 2004, vol. 60 (1), pp. S259.
Shen S., et al., "Practical Determination of Patient-Specific Marrow Dose Using Radioactivity Concentration In Blood and Body," Journal of Nuclear Medicine, Dec. 1999, vol. 40 (12), pp. 2102-2106.
Shen S., et al., "Radiation Dosimetry of 131I-Chlorotoxin for Targeted Radiotherapy In Glioma-Bearing Mice,"Journal of Neuro-Oncology, Jan. 2005, vol. 71 (2), pp. 113-119.
Shimizu Y., et al., "Development of Novel Nanocarrier-Based Near-Infrared Optical Probes for In Vivo Tumor Imaging," Journal of Fluorescence, Mar. 2012, vol. 22 (2), pp. 719-727.
Shiue L., "Identification of Candidate Genes for Drug Discovery By Differential Display," Drug Development Research, 1997, vol. 41, pp. 142-159.
Silva R.L.E., et al., "Agents that Bind Annexin A2 Suppress Ocular Neovascularization," Journal of Cellular Physiology, Nov. 2010, vol. 225 (3), pp. 855-864.
Skolnick J., et al., "From Genes To Protein Structure and Function: Novel Applications of Computational Approaches In The Genomic Era," Trends in Biotech, Jan. 2000, vol. 18 (1), pp. 34-39.
Smith B.D., et al., "Molecular Markers In Head and Neck Squamous Cell Carcinoma: Their Biological Function and Prognostic Significance," Annals of Otology, Rhinology, and Laryngology, Mar. 2001, vol. 110 (3), pp. 221-228.
Somogyi P., et al., "Subcellular Localization of Benzodiazepine/Gabaa Receptors In The Cerebellum of Rat, Cat, and Monkey Using Monoclonal Antibodies," Journal of Neuroscience, Jun. 1, 1989, vol. 9 (6), pp. 2197-2209.
Sontheimer H "Voltage-Dependent Ion Channels In Glial Cells," Glia, Jun. 1994, vol. 11 (2), pp. 156-172.
Soroceanu L., et al., "Modulation of Glioma Cell Migration and Invasion Using Cl(-) and K(+) Ion Channel Blockers," The Journal of Neuroscience, Jul. 15, 1999, vol. 19 (14), pp. 5942-5954.
Stabin M.G., "Mirdose: Personal Computer Software for Internal Dose Assessment In Nuclear Medicine," The Journal of Nuclear Medicine, Mar. 1996, vol. 37 (3), pp. 538-546.
Steinmeyer K., et al., "Cloning and Functional Expression of Rat Clc-5, A Chloride Channel Related To Kidney Disease," The Journal of Biological Chemistry, Dec. 29, 1995, vol. 270 (52), pp. 31172-31177.

Stewart L.A., "Chemotherapy In Adult High-Grade Glioma: A Systematic Review and Meta-Analysis of Individual Patient Data from 12 Randomised Trials," Lancet, Mar. 23, 2002, vol. 359 (9311), pp. 1011-1018.
Stroud M.R., et al., "In Vivo Bio-Imaging Using Chlorotoxin-Based Conjugates," Current Pharmaceutical Design, Dec. 2011, vol. 17 (38), pp. 4362-4371.
Stupp R., et al., "Current and Future Developments In The Use of Temozolomide for The Treatment of Brain Tumours," Lancet Oncol, Sep. 2001, vol. 2 (9), pp. 552-560.
Sun C., et al., "In Vivo Mri Detection of Gliomas By Chlorotoxin-Conjugated Superparamagnetic Nanoprobes," Small, Mar. 2008, vol. 4 (3), pp. 372-379.
Sun C., et al., "Tumor-Targeted Drug Delivery and Mri Contrast Enhancement By Chlorotoxin-Conjugated Iron Oxide Nanoparticles," Nanomedicine (Lond), Aug. 2008, vol. 3 (4), pp. 495-505.
Sun S., et al., "Size-Controlled Synthesis of Magnetite Nanoparticles," Journal of the American Chemical Society, Jul. 17, 2002, vol. 124 (28), pp. 8204-8205.
Supplemental Partial European Search Report Patent for Application No. EP00926105, dated Mar. 11, 2003, 4 pages.
Supplementary European Search Report for Patent Application No. EP05763889.2, dated Sep. 24, 2007, 4 pages.
Supplementary Partial European Search Report Patent Application No. EP03731504, dated Aug. 28, 2007, 8 pages.
Swart P.J., et al., "Homing of Negatively Charged Albumins To The Lymphatic System: General Implications for Drug Targeting To Peripheral Tissues and Viral Reservoirs," Biochem Pharmacol, Nov. 1, 1999, vol. 58 (9), pp. 1425-1435.
Syed S.P., et al., "Angiostatin Receptor Annexin II In Vascular Tumors Including Angiosarcoma,"Human Pathology, Mar. 2007, vol. 38 (3), pp. 508-513.
"Taber's Cyclopedic Medical Dictionary," F.A. Davis Company, Philadelphia, 1985, vol. 274, 3 pages.
Tan P.T.J., et al., "Deduction of Functional Peptide Motifs In Scorpion Toxins," Journal of Peptide Science, Jan. 23, 2006, vol. 12 (6), pp. 420-427.
Tanaka E., et al., "Image-Guided Oncologic Surgery Using Invisible Light: Completed Pre-Clinical Development for Sentinel Lymph Node Mapping," Annals of Surgical Oncology, Dec. 2006, vol. 13 (12), pp. 1671-1681.
Tanaka T., et al., "Redox Regulation of Annexin 2 and Its Implications for Oxidative Stress-Induced Renal Carcinogenesis and Metastasis," Oncogene, May 13, 2004, vol. 23 (22), pp. 3980-3989.
Tatenhorst L., et al., "Knockdown of Annexin 2 Decreases Migration of Human Glioma Cells In Vitro," Neuropathology and Applied Neurobiology, Jun. 2006, vol. 32 (3), pp. 271-277.
Tatikolov a S., et al., "Complexation of Polymethine Dyes With Human Serum Albumin: A Spectroscopic Study," Biophysical chemistry, Jan. 2004, vol. 107 (1), pp. 33-49.
Te Velde E.A., et al., "The Use of Fluorescent Dyes and Probes In Surgical Oncology," European Journal of Surgical Oncology, Jan. 2010, vol. 36 (1), pp. 6-15.
The Free Dictionary. American Heritage Medical Dictionary Defines The Word "Systemic". 2007, 1 Page.
"Thermo Scientific Pierce Fluorescent Products Guide-Fluorescent Labeling and Detection," Thermoscientific, Jan. 2012, 28 pages.
Timmerman L., "Blaze Bioscience, Fred Hutch Spinoff With Zymo Vet At The Helm, Seeks To "Paint" Tumors," Xconomy, Oct. 18, 2011, 3 pages.
Torchilin, et al., "Peptide and Protein Drug Delivery to and Into Tumors: Challenges and Solutions," Drug Discovery Today, Mar. 15, 2003, vol. 8 (6), pp. 259-266.
Transmolecular., "A Phase I Imaging and Safety Study of Intravenous 131-1-Tm-601 Labeled Chlorotoxin In Patients With Recurrent Or Refractory Somatic and/Or Cerebral Metastatic Solid Tumors," Clinical Trials Nct00379132, 2006-2008, 3 pages.
Troyan S.L., et al., "The Flare Intraoperative Near-Infrared Fluorescence Imaging System: A First-In-Human Clinical Trial In Breast Cancer Sentinel Lymph Node Mapping," Annals of Surgical Oncology, Oct. 2009, vol. 16 (10), pp. 2943-2952.

(56) References Cited

OTHER PUBLICATIONS

Tytgat J., et al., "Purification and Partial Characterization of A 'Short' Insectotoxin-Like Peptide from The Venom of The Scorpion Parabuthus Schlechteri," FEBS Letters, Dec. 28, 1998, vol. 441 (3), pp. 387-391.
Uchida S., et al., "Localization and Functional Characterization of Rat Kidney-Specific Chloride Channel, ClC-K1," Journal of Clinical Investigation, Jan. 1995, vol. 95(1), pp. 104-113.
Ullrich, et al., "Biophysical and Pharmacological Characterization of Chloride Currents In Human Astrocytoma Cells," American Journal of Physiology, May 1996, vol. 270 (5 Pt 1), pp. C1511-C1521.
Ullrich N., et al., "Cell Cycle-Dependent Expression of A Glioma-Specific Chloride Current: Proposed Link To Cytoskeletal Changes," The American Journal of Physiology, Oct. 1997, vol. 273(4), pp. C1290-C1297.
Ullrich N., et al., "Expression of Voltage-Activated Chloride Currents In Acute Slices of Human Gliomas," Neuroscience, Apr. 1998, vol. 83(4), pp. 1161-1173.
Ullrich N., et al., "Human Astrocytoma Cells Express A Unique Chloride Current," Neuroreport, Apr. 10, 1996, vol. 7(5), pp. 1020-1024.
UniProt Database, Accession No. P45639, Aug. 23, 2007, 1 Page.
Vail D.M., "Veterinary Co-Operative Oncology Group-Common Terminology Criteria for Adverse Event (VCOG-CTCAE) Following Chemotherapy or Biological Antineoplastic Therapy in Dogs and Cats v1.0," Veterinary Co-Operative Oncology, Dec. 2004, vol. 2(4), pp. 194-213.
Veber D.F., et al., "The Design of Metabolically-Stable Peptide Analogs," Trends In Neurosciences, Sep. 1985, vol. 8, pp. 392-396.
Veiseh O., et al., "A Ligand-Mediated Nanovector for Targeted Gene Delivery and Transfection In Cancer Cells," Biomaterials, Feb. 2009, vol. 30(4), pp. 649-657.
Veiseh O., et al., "Optical and Mri Multifunctional Nanoprobe for Targeting Gliomas," Nano Letters, Jun. 2005, vol. 5(6), pp. 1003-1008.
Veiseh O., et al., "Specific Targeting of Brain Tumors with an Optical/Magnetic Resonance Imaging Nanoprobe across the Blood-Brain Barrier," Cancer Research, Aug. 1, 2009, vol. 69(15), pp. 6200-6207.
Velde E.A., et al., "The Use of Fluorescent Dyes and Probes in Surgical Oncology," European Journal of Surgical Oncology, Jan. 2010, vol. 36(1), pp. 6-15.
"VIVOTAG, 680 XL In Vivo Fluorochrome Label," Perkin Elmer, NIR Flurochrome Label, Product No. Nev11119, 2010, 2 Pages.
Voet D., et al., "Biochemistry," Second Edition, John Wiley & Sons, Incorporated, Chapter 9, Hemoglobin Protein Function in Microcosm, 1995, pp. 235-241.
Weissleder R., et al., "Shedding Light Onto Live Molecular Targets," Nature Medicine, Jan. 2003, vol. 9(1), pp. 123-128.
Wen S., et al., "PTEN Controls Tumor-Induced Angiogenesis,"Proceedings of the National Academy of Sciences, USA, Apr. 10, 2001, vol. 98(8), pp. 4622-4627.
Wilson G.F., et al., "Mitogenic Factors Regulate ion Channels in Schwann Cells Cultured from Newborn Rat Sciatic Nerve," Journal of Physiology, Oct. 1993, vol. 470, pp. 501-520.
Wishart D.S., et al., "1H, 13C and 15N Chemical Shift Referencing in Biomolecular NMR," Journal of Biomolecular NMR, Sep. 1995, vol. 6(2), pp. 135-140.
Woodfork K.A., et al., "Inhibition of ATP-Sensitive Potassium Channels Causes Reversible Cell-Cycle Arrest of Human Breast Cancer Cells in Tissue Culture," Journal of Cellular Physiology, Feb. 1995, vol. 162(2), pp. 163-171.
Written Opinion for International PCT Patent Application No. PCT/US2006/010170, dated Oct. 22, 2007, 8 pages.
Yasuda M., et al., "Identification of a Tumour Associated Antigen in Lung Cancer Patients with Asbestos Exposure," Anticancer Research. Jul. 2010, vol. 30(7), pp. 2631-2639.
Ye Y., et al., "Integrin Targeting for Tumor Optical Imaging," Theranostics, 2011, vol. 1, pp. 102-126.

Yewey G.L., et al., "Delivery of Proteins from a Controlled Release Injectable Implant," in Protein Delivery Physical Systems, Sanders and Hendren (eds.), Plenum Press, 1997, pp. 93-117.
Zellner A., et al., "Disparity in Expression of Protein Kinase C Alpha in Human Glioma Versus Glioma-Derived Primary Cell Lines: Therapeutic Implications," Clinical Cancer Research, Jul. 1, 1998, vol. 4(7), pp. 1797-1802.
Zhang Y., et al., "Surface Modification of Superparamagnetic magnetite Nanoparticles and Their Intracellular Uptake," Biomaterial, 2002, vol. 23, pp. 1553-1561.
Zhao S., et al., "Intraoperative Fluorescence-guided Resection of High-grade Malignant Gliomas using 5-aminolevulinic Acid-induced Porphyrins: A Systematic Review and Meta-analysis of Prospective Studies," PLoS One, May 28, 2013, vol. 8(5), e63682, doi:10.1371/journal.pone.0063682, Print 2013.
Zips D., et al., "New Anticancer Agents: In vitro and In vivo Evaluation," In Vivo, 2005, vol. 19(1), pp. 1-8.
Bae T.K., "Intravenous Contrast Medium Administration and Scan Timing at CT," Radiology, 2010, vol. 256(1), pp. 32-61.
Betheme, IV Bolus vs. IV Push: What's the Difference,https://lonestarivmedics.com/iv-bolus-vs-iv-push/, 2021, 4 pages.
Contrast Administration (Bolus vs Infusion), European Society of Cardiology, https://www.escardio.org/Education/Practice-Tools/EACVI-toolboxes/Contrast-Echo/Lectures/Contrast-administration-bolus-vs-infusion, 2021, 5 pages.
Akdag, et al., "The Uptake Mechanism of the Cell-Penetrating pVEC Peptide," J. Chern, 2013, Mar. 10, 2013, 10 pages.
Akhmedov D., et al., "Knock-in Luciferase Reporter Mice for in Vivo Monitoring of CREB Activity," PLoS One, vol. 11(6), Jun. 13, 2016, 13 Pages.
Almagro J.C., et al., "Progress and Challenges in the Design and Clinical Development of Antibodies for Cancer Therapy," Frontiers in immunology, Jan. 4, 2018, vol. 8, pp. 1751, doi:10.3389/fimmu.2017.01751 https://www.frontiersin.org/articles/10.3389/fimmu.2017.01751/full.
Altschul, et al., "Optimal Sequence Alignment using Affine Gap Costs," Bulletin of Mathematical Biology, Feb. 17, 1986, vol. 48(5-6), pp. 603-616.
Alves H C., et al., "Animal Models of Bone Loss in Inflammatory Arthritis: from Cytokines in the Bench to Novel Treatments for Bone Loss in the Bedside-a Comprehensive Review," Clin Rev Allergy Immunol, Aug. 2016, vol. 51(1), pp. 27-47, doi: 10.1007/s12016-015-8522-7.
Appelbaum J.S., et al., "Arginine Topology Controls Escape of Minimally Cationic Proteins from Early Endosomes to the Cytoplasm," Chem. Biol. Jul. 27, 2012, vol. 19, pp. 819-830.
Ashkenazi A., et al., "From Basic Apoptosis Discoveries to Advanced Selective BCL-2 Family Inhibitors," Nature Reviews Drug Discovery, 2017, vol. 16, pp. 273-284, Published online:Feb. 17, 2017. doi:10.1038/nrd.2016.253.
Baar M.P., et al., "Targeted Apoptosis of Senescent Cells Restores Tissue Homeostasis in Response to Chemotoxicity and Aging," Cell 169.1, Mar. 23, 2017, pp. 132-147.
Bagal S.K., et al., "Ion Channels as Therapeutic Targets: A Drug Discovery Perspective," J Med Chem, Feb. 14, 2013, vol. 56(3), pp. 593-624, doi: 10.1021/jm3011433. Epub Nov. 29, 2012.
Baik F.M., et al., "Fluorescence Identification of Head and Neck Squamous Cell Carcinoma and High-Risk Oral Dysplasia With BLZ-100, a Chlorotoxin-Indocyanine Green Conjugate," JAMA Otolaryngol Head Neck Surg, Published on line Feb. 18, 2016, vol. 142, Issue. 4, pp. 330-338, doi: 10.1001/jamaoto.2015.3617; JAMA Otolaryngol Head Neck Surg. Apr. 1, 2016.
Baker N.A., et al., "Electrostatics of Nanosystems: Application to Microtubules and the Ribosome," Proc Natl Acad Sci U S A, Aug. 28, 2001, vol. 98(18), pp. 10037-10041.
Balayssac S., et al., "Comparison of Penetratin and Other Homeodomain-Derived Cell-Penetrating Peptides: Interaction in a Membrane-Mimicking Environment and Cellular Uptake Efficiency," Biochemistry, Dec. 1, 2006, vol. 45, pp. 1408-1420.
Bandaranayake A.D., et al., "Daedalus: A Robust, Turnkey Platform for Rapid Production of Decigram Quantities of Active Recombi-

(56) References Cited

OTHER PUBLICATIONS nant Proteins in Human Cell Lines using Novel Lentiviral Vectors," Nucleic Acids Res, Nov. 2011, vol. 39(21), pp. 1-143, doi: 10.1093/nar/gkr706, Epub Sep. 12, 2011.

Bao Q., et al., "The Tripeptide Phenylalanine-(D) Glutamate-(D) Glycine Modulates Leukocyte Infiltration and Oxidative Damage in Rat injured Spinal Cord," Neuroscience, Jul. 7, 2006, vol. 140(3), pp. 1011-1022, Epub Apr. 3, 2006.

Barad M., et al., "Rolipram, a type IV-specific Phosphodiesterase Inhibitor, Facilitates the Establishment of Long-lasting Long-term Potentiation and Improves Memory," Proceedings National Academy Sciences, Oct. 13, 1998, vol. 95, pp. 15020-15025.

Barchetta I., et al., "Neurotensin Is a Lipid-Induced Gastrointestinal Peptide Associated with Visceral Adipose Tissue Inflammation in Obesity," Nutrients, Apr. 23, 2018, vol. 10, pp. 1-526.

Bar-Or D., et al., "A Randomized Clinical Trial to Evaluate Two Doses of an Intra-articular Injection of LMWF-5A in Adults with Pain due to Osteoarthritis of the Knee," PLoS One, Feb. 3, 2014, vol. 9(2), e87910, 8 pages, doi: 10.1371/journal.pone.0087910, eCollection 2014.

Bar-Or D., et al., "Low Molecular Weight Fraction of Commercial Human Serum Albumin Induces Morphologic and Transcriptional Changes of Bone Marrow-Derived Mesenchymal Stem Cells," Stem Cells Translational Medicine, Aug. 2015, vol. 4(8), pp. 945-955.

Barton., et al., "Protein Secondary Structure Prediction," Current Opinion in Structural Biology, Jun. 1995. vol. 5(3), pp. 372-376.

Bendtsen, et al., "Improved Prediction of Signal Peptides: SignalP 3.0," Journal of molecular biology, Jul. 2004, vol. 340, pp. 783-795.

Benedek T.G., "History of the Development of Corticosteroid Therapy," Clinical and Experimental Rheumatology, Sep.-Oct. 2011, vol. 29(5 Suppl 68), S-5-12, Epub Oct. 21, 2011, 8 pages.

Berger S., et al., "Computationally designed high specificity inhibitors delineate the roles of BCL2 family proteins in cancer", Nov. 2, 2016, Elife 5, e20352, 31 pages.

Berman, et al., "The Protein Data Bank," Nucleic acids research, vol. 28, No. 1, Jan. 2000, pp. 235-242.

Bernard J.C., et al., "Identification of an Interleukin-15alpha Receptor-binding Site on Human Interleukin-15," Journal of Biological Chemistry, Jun. 4, 2004, vol. 279(23), pp. 24313-24322.

Bernhard J.C., et al., "Should we use Cells, Biomaterials, or Tissue Engineering for Cartilage Regeneration?," Stem Cell Research & Therapy, Dec. 2016, vol. 7, Issue. 1, 9 pages, DOI: 10.1186/S13287-016-0314-3.

Beyder A., et al., "Targeting Ion Channels for the Treatment of Gastrointestinal Motility Disorders," Therapeutic Advances in Gastroenterology, Jan. 2012, vol. 5(1), pp. 5-21.

Bhardwaj, et al., "Accurate de novo Design of Hyperstable Constrained Peptides," Nature 538, Oct. 20, 2016, pp. 329-335.

Bjellqvist B., et al., "Reference Points for Comparisons of Two-dimensional Maps of Proteins from Different Human Cell types defined in a pH Scale where Isoelectric Points Correlate with Polypeptide Compositions," Electrophoresis, Mar.-Apr. 1994, vol. 15(3-4), pp. 529-539.

Bjellqvist B., et al., "The Focusing Positions of Polypeptides in Immobilized pH Gradients can be Predicted from their Amino Acid Sequences," Electrophoresis, Oct. 1993, vol. 14(10), pp. 1023-1031.

Bodenhofer U., et al., "Msa: an R Package for Multiple Sequence Alignment," Bioinformatics, Dec. 2015, vol. 31, Issue. 24, pp. 3997-3999.

Bohlen C.J., et al., "A Bivalent Tarantula Toxin Activates the Capsaicin Receptor, TRPV1, by targeting the outer pore domain," Cell, May 28, 2010, vol. 141, pp. 834-845.

Boisseau S., et al., "Cell Penetration Properties of Maurocalcine, A Natural Venom Peptide Active on the Intracellular Ryanodine Receptr,o" Biochimica et Biophysica Acta—Biomembr, Mar. 2006, vol. 1758, pp. 308-319.

Boswell C.A., et al., "Comparative Physiology of Mice and Rats: Radiometric Measurement of Vascular Parameters in Rodent Tissues," Apr. 7, 2014, vol. 11, pp. 1591-1598.

Bouchaud, et al., "The Exon-3-encoded Domain of IL-15ralpha Contributes to IL-15 High-affinity Binding and is crucial for the IL-15 antagonistic effect of soluble IL-15Ralpha," Journal of Molecular Biology, Sep. 26, 2008, vol. 382, Issue. 1, pp. 1-12.

Boules M., et al., "Diverse Roles of Neurotensin Agonists in the Central Nervous System", Front Endocrinol (Lausanne), Mar. 22, 2013, vol. 4(36).

Brattsand R., "Overview of Newer Glucocorticosteroid Preparations for Inflammatory Bowel Disease. IDB: Trends in Medical Therapy," Canadian Journal of Gastroenterology, Nov. 7, 1990, vol. 4(7), pp. 407-414.

Brüggemann M., et al., "Human Antibody Production in Transgenic Animals," Arch. Immunol. Ther. Exp. (Warsz), 2015, vol. 63, pp. 101-108.

Bruno B.J., et al., "Basics and Recent Advances in Peptide and Protein Drug Delivery," Ther Deliv, Nov. 4, 2013, vol. 4 (11), pp. 1443-1467.

Burns C.M., "The History of Cortisone Discovery and Development," Rheumatic Disease Clinics of North America, Feb. 2016, vol. 42 (1), pp. 1-14.

Butoescu N., et al., "Dexamethasone-Containing PLGA Superparamagnetic Microparticles as Carriers for the Local Treatment of Arthritis," Biomaterials, Mar. 2009, vol. 30, Issue. 9, pp. 1772-1780, doi: 10.1016/j.biomaterials.2008.12.017. Epub Jan. 8, 2009, 9 pages.

Butte P.V., et al., "Near-Infrared Imaging of Brain Tumors Using the Tumor Paint BLZ-100 to Achieve Near-complete Resection of Brain tumors.," Neurosurg Focus, Feb. 2014, vol. 36 (2), E1, 8 pages.

Carver T., et al., "The Design of Jemboss: A Graphical User Interface to EMBOSS," Bioinformatics, Sep. 22, 2003, vol. 19 (14), pp. 1837-1843.

Chaturvedi M., et al., "A Review on Mucoadhesive Polymer used in Nasal Drug Delivery System," Journal of Advanced Pharmaceutical Technology & Research, Oct. 2011, vol. 2 (4), pp. 215-222, doi: 10.4103/2231-4040.90876.

Chen J., et al., "Protein-protein Interactions: General Trends in the Relationship between Binding Affinity and Interfacial Buried Surface Area," Protein Science, Apr. 2013, vol. 22 (4), pp. 510-515.

Chen S., et al., "A Targeted IL-15 Fusion Protein with Potent Anti-tumor activity," Cancer biology & therapy, Sep. 2015, vol. 16 (8), pp. 1415-1421.

Chen Y., et al., "The Application of Aptamer in Apoptosis," Biochimie, Jan. 2017, vol. 132, pp. 1-8.

Chen Z., et al., "Toxin Acidic Residue Evolutionary Function-guided Design of De Novo Peptide Drugs for the Immunotherapeutic Target, the Kv1. 3 Channel," Scientific reports, May 8, 2015, vol. 5(1), 8 Pages.

Chen Z., et al., "Unusual Binding Mode of Scorpion Toxin BmKTX onto Potassium Channels Relies on its Ristribution of Acidic Residues," Biochemical and biophysical research communications, Apr. 3, 2014, vol. 447, pp. 70-76.

Cheung C.S.F., et al., "Identification of Chondrocyte-binding Peptides by Phage Display," Journal of Orthopaedic research, Jul. 2013, vol. 31, pp. 1053-1058.

Choi D-K., et al., "A General Strategy for Generating Intact, Full-length IgG Antibodies that Penetrate into the Cytosol of Living Cells," MAbs, Dec. 2014, vol. 6(6), pp. 1402-1414.

Collaborative computational Project, No. 4. "The CCP4 suite: Programs for Protein Crystallography," Acta crystallographica. Section D, Biological crystallography, Sep. 1, 1994, vol. 50 (Pt 5), pp. 760-763.

Compton J.T., et al., "A Review of Osteocyte Function and the Emerging Importance of Sclerostin," Journal of Bone and Joint Surgery, Oct. 1, 2014, vol. 96 (19), pp. 1659-1668, doi: 10.2106/JBJS.M.01096.

Corbi-Verge C., et al., "Strategies to Develop Inhibitors of Motif-Mediated Protein-Protein Interactions as Drug Leads," Annual Review of Pharmacology and Toxicology, Jan. 6, 2017, vol. 57, pp. 39-60.

(56) References Cited

OTHER PUBLICATIONS

Cordes M,H.J., et al., "Sequence Space, Folding and Protein Design," Current Opinion in Structural Biology, Feb. 1996, vol. 6(1), pp. 3-10.

Correnti C.E., et al., "Screening, Large-scale Production, and Structure-based Classification for Cystine-dense Peptides," Nature Structural & Molecular Biology, Mar. 2018, vol. 25 (3), pp. 270-278.

Craik D.J., et al., "Potential Therapeutic Applications of the Cyclotides and Related Cystine Knot Mini-proteins," Expert Opinion on Investigational Drugs, May 2007, vol. 16 (5), pp. 595-604.

Crook Z.R., et al., "Mammalian Display Screening of Diverse Cystine-Dense Peptides for Difficult to Drug Targets", Nature Communications, Dec. 21, 2017, vol. 8 (1), 15 pages, XP055606762.

Crowley P. J., et al., "Bioorganic & Medicinal Chemistry The Role of Molecular Modeling in the Design of Analogues of the Fungicidal Natural Products Crocacins A and D," Bioorganic & Medicinal Chemistry, Dec. 15, 2008, vol. 16 (24), pp. 10345-10355.

Daly N.L., et al., "Bioactive Cystine Knot Proteins," Current Opinion in Chemical Biology, Jun. 2011, vol. 15(3), pp. 362-368, doi: 10.1016/j.cbpa.2011.02.008. Epub Feb. 27, 2011.

Dancevic C.M., et al., "Current and Emerging Therapeutic Strategies for Preventing Inflammation and Aggrecanase-mediated Cartilage Destruction in Arthritis," Arthritis Research & Therapy, Sep. 2014, vol. 16 (5), pp. 429.

Daniels T.R., et al., "The Transferrin Receptor and the Targeted Delivery of Therapeutic Agents against Cancer," Biochimica et Biophysica Acta—General Subjects, Mar. 2012, vol. 1820 (3), pp. 291-317.

Davis, W., et al., "MolProbity: All-atom Contacts and Structure Validation for Proteins and Nuleic Acids," Nucleic acids research, Jul. 1, 2007, vol. 35 (2), pp. W375-W383.

De Coupade., et al., "Novel Human-derived Cell-penetrating Peptides for Specific Subcellular Delivery of Therapeutic Biomolecules," Biochemical Journal, Sep. 2005, vol. 390, pp. 407-418.

De Groot., et al., "Glucocorticoid Therapy and Adrenal Suppression. 2000," South Dartmouth (MA): MDText.com, Inc, Oct. 19, 2018, 27 pages.

Derakhshankhah H., et al., "Cell Penetrating Peptides: A Concise Review with Emphasis on Biomedical Applications," Biomedicine & Pharmacotherapy, Dec. 2018, vol. 108, pp. 1090-1096.

Derendorf H., et al., "Pharmacokinetics and Pharmacodynamics of Glucocorticoid Suspensions after Intra-articular Administration," Clinical Pharmacology & Therapeutics, Mar. 1986, vol. 39(3), pp. 313-317.

Dohmen C., et al., "Multifunctional CPP Polymer System for Tumor-targeted pDNA and siRNA Delivery," Methods in Molecular Biology, 2011; vol. 683, pp. 453-463, doi: 10.1007/978-1-60761-919-2_32.

Dolinsky T.J., et al., "PDB2PQR: Expanding and Upgrading Automated Preparation of Biomolecular Structures for Molecular Simulations," Nucleic Acids Research, Jul. 2007, vol. 35(Web Server issue), pp. W522-W525.

Dou P.Q., et al., "Overview of Proteasome Inhibitor-based Anticancer Therapies: Perspective on Bortezomib and Second Generation Proteasome Inhibitors versus Future Generation Inhibitors of Ubiquitin-proteasome System," Current Cancer Drug Targets, Dec. 30, 2014, vol. 14(6), pp. 517-536.

D'Souza C., et al., "Structural Parameters Modulating the Cellular Uptake of Disulfide-rich Cyclic Cell-penetrating Peptides: MCoTI-II and SFTI-1," Eur. Journal of Medicinal Chemistry, Jun. 24, 2014, vol. 88, pp. 10-18.

Drake M.T., et al., "Bisphosphonates: Mechanism of Action and Role in Clinical Practice," Mayo Clinic Proceedings, Sep. 2008, vol. 83 (9), pp. 1032-1045.

Drin G., et al., "Physico-chemical Requirements for Cellular Uptake of pAntp Peptide: Role of lipid-binding affinity," European Journal of Biochemistry, Mar. 2001, vol. 268, pp. 1304-1314.

Drug Bank, Retrived from: [https://www.drugbank.ca/drugs/DB01248 created Jun. 13, 2005], updated Nov. 22, 2019, 18 Pages.

Duchardt F., et al., "A Cell-penetrating Peptide derived from Human Lactoferrin with Conformation-dependent Uptake Efficiency," Journal of Biological Chemistry, Dec. 25, 2009, vol. 284, pp. 36099-36108.

Ducry L., et al., "Antibody-drug Conjugates: Linking Cytotoxic Payloads to Monoclonal Antibodies," Bioconjugate Chemistry. Jan. 2010, vol. 21 (1), pp. 5-13, doi:10.1021/bc9002019.

Dulhunty A.F., et al., "Multiple Actions of Imperatoxin A on Ryanodine Receptors: Interactions with the II-III loop 'A' fragment," Journal of Biological Chemistry, Mar. 19, 2004, vol. 279, pp. 11853-11862.

Elmallah M., et al., "Marine Drugs Regulating Apoptosis Induced by Tumor Necrosis Factor-Related Apoptosis-Inducing Ligand (TRAIL)," Mar Drugs, Nov. 13, 2015, vol. 13 (11), pp. 6884-6909, doi: 10.3390/md13116884.

EMBOSS iep. Available at http://emboss.sourceforge.net/apps/release/6.6/emboss/apps/iep.html. Accessed on Dec. 26, 2018, 12 pages.

Emsley P., et al., "Coot: Model-building Tools for Molecular Graphics," Acta crystallographica Section D, Biological crystallography 60, Aug. 4, 2004, pp. 2126-2132.

Erazo-Oliveras A., et al., "Protein Delivery into Live Cells by Incubation with an Endosomolytic Agent," Nature Methods 11, Jun. 15, 2014, pp. 861-867.

Esteve E., et al., "Critical Amino Acid Residues Determine the Binding Affinity and the Ca 2+ Release Efficacy of Maurocalcine in Skeletal Muscle Cells," Journal of Biological Chemistry, Sep. 26, 2003, vol. 278, pp. 37822-37831.

Everts S., "Can We Hit the Snooze button on Aging?," Chemical & Engineering News 95, Mar. 6, 2017, vol. 10, pp. 31-35.

Extended European Search Report for European application, No. EP16815459.9 dated Nov. 28, 2018, 11 pages.

Farr J., et al., "Clinical Cartilage Restoration: Evolution and Overview," Clin Orthop Relat Res, Oct. 2011, vol. 469, Issue. 10, pp. 2696-2705, doi: 10.1007/s11999-010-1764-z.

Fidel J., et al., "Preclinical Validation of the Utility of BLZ-100 in Providing Fluorescence Contrast for Imaging Spontaneous Solid Tumors," Cancer Research, Oct. 15, 2015, vol. 75, No. 20, pp. 4283-4291.

Finton K.A.K., et al., "Autoreactivity and Exceptional CDR Plasticity (but Not Unusual Polyspecificity) Hinder Elicitation of the Anti-HIV Antibody 4E10," PLoS Pathog. Sep. 26, 2013, e1003639, 20 pages.

Fischer U., et al., "Apoptosis-based Therapies and Drug Targets," Cell Death Differ, Aug. 2005, vol. 12, Suppl 1, pp. 942-961.

Fu Q., et al., "Programmed Hydrolysis in Designing Paclitaxel Prodrug for Nanocarrier Assembly," Scientific Reports, Jul. 13, 2015, 5:12023, 10 pages.

Furtek S.L., et al., "Strategies and Approaches of Targeting STAT3 for Cancer Treatment," ACS Chem. Biol., Jan. 5, 2016, vol. 11, pp. 308-318.

Garcia R., et al., "Constitutive Activation of Stat3 by the Src and JAK Tyrosine Kinases Participates in Growth Regulation of Human Breast Carcinoma Cells," Oncogene, vol. 20, May 2001, pp. 2499-2513.

Gasteiger E., et al., "Protein Identification and Analysis Tools on the ExPASy Server," Excerpt, available at: http://web.expasy.org/compute_pi/pi_tool-doc.html. Accessed Nov. 7, 2018, 3 Pages.

Gasteiger E., et al., "Protein Identification and Analysis Tools on the ExPASy Server. (In) John M. Walker (ed):," The Proteomics Protocols Handbook, Humana Press, (2005, pp. 571-607.

Gautam A., et al., "Topical Delivery of Protein and Peptide Using Novel Cell Penetrating Peptide IMT-P8," Sci. Rep. 6, 2016, p. 26278 May 18, 2016, 13 pages.

Geissler J.R, et al. American Society of Biomechanics Journal of Biomechanics Award 2013: cortical bone tissue mechanical quality and biological mechanisms possibly underlying atypical fractures. J Biomech. Apr. 13, 2015;48(6):. doi: 10.1016/j.jbiomech.2015.01.032. Epub Feb. 2, 2015, 30 pages.

Gelly J., et al., "The KNOTTIN Website and Database: A New Information System Dedicated to the Knottin Scaffold," Nucleic Acids Research 32, 2004, suppl_1, pp. D156-D159.

(56) References Cited

OTHER PUBLICATIONS

Geng Q., et al., "Peptide-drug Conjugate Linked via a Disulfide Bond for Kidney Targeted Drug Delivery," Bioconjug Chem. Jun. 20, 2012, vol. 23, Issue. 6, pp. 1200-1210, doi: 10.1021/bc300020f. Epub Jun. 12, 2012.

Gibson C.J, et al., "BCL-2 Antagonism to Target the Intrinsic Mitochondrial Pathway of Apoptosis," Clin Cancer Res. Nov. 15, 2015, vol. 21, Issue. 22, pp. 5021-5029. doi: 10.1158/1078-0432. CCR-15-0364, 9 Pages.

Goldring M.B., et al., "Emerging Targets in Osteoarthritis Therapy," Curr Opin Pharmacol, Jun. 2015, vol. 22, pp. 51-63. Published online Apr. 10, 2015. doi: 10.1016/j.coph.2015.03.004, 25 Pages.

Goodsell D., "Multidrug Resistance Transporters: Many bacteria use multidrug resistance transporters to pump drugs and poisons out of the cell". Molecule of the Month. Web article. Protein Data Bank (PDB-101). Nov. 2007. 3 pages. URL: https://pdb101.rcsb.org/motm/95, 3 Pages.

Gothard D., et al., "Tissue Engineered Bone using Select Growth factors: A Comprehensive Review of Animal Studies and Clinical Translation Studies in Man," Eur Cell Mate, Oct. 6, 2014, vol. 28, pp. 166-207, 43 Pages.

Gould A., et al., "Cyclotides, a Novel Ultrastable Polypeptide Scaffold for Drug Discovery," Current Pharmaceutical Design 17, Dec. 2011, vol. 38, pp. 4294-4307, 26 Pages.

Gump J.M., et al., "TAT Transduction: The Molecular Mechanism and Therapeutic Prospects," Trends Mol Med, Oct. 4, 2007, vol. 13, Issue. 10, pp. 443-448, 6 Pages.

Guo W., et al., "Protection Against Th17 Cells Differentiation by an Interleukin-23 Receptor Cytokine-Binding Homology Region," PLoS One, Sep. 19, 2012, vol. 7, Issue. 9, pp. e45625, 10 Pages.

Gurrola G.B., et al., "Imperatoxin A, a Cell-Penetrating Peptide from Scorpion Venom, as a Probe of Ca-Release Channels/Ryanodine Receptors," Pharmaceuticals (Basel). 3, Apr. 1, 2010, pp. 1093-1107, 15 Pages.

Guzman F., et al., "Mechanism of Action, Indications and Adverse Effects of: Etanercept, Infliximab and Adalimumab," Pharmacoloy Corner. Available at: http://pharmacologycorner.com/mechanism-of-action-indications-and-adverse-effects-of-etanercept-infliximab-and-adalimumab. Accessed Nov. 7, 2018, 7 Pages.

Haas M., et al., "Drug-targeting to the Kidney: Renal Delivery and Degradation of a Naproxen-lysozyme Conjugate In vivo," Kidney Int, Dec. 1997, vol. 52, Issue. 6, pp. 1693-1699, 7 p.

Hainer B.L., et al., "Diagnosis, treatment, and prevention of gout," Am Fam Physician, Dec. 15, 2014, vol. 90, Issue. 12, pp. 831-836, 6 Pages.

Hammaker D., et al., "Go Upstream, Young man": Lessons learned from the p38 saga, Ann Rheum Dis, Jan. 2010, 69 Suppl 1:77-82. doi: 10.1136/ard.2009.119479, 14 Pages.

Hamman J.H., et al., "Oral Delivery of Peptide Drugs: Barriers and Developments," BioDrugs, 2005, vol. 19, Issue. 3, pp. 165-177, 13 Pages.

Han S., et al., "Structural Basis of a Potent Peptide Inhibitor Designed for Kv1.3 Channel, A Therapeutic Target of Autoimmune Disease", Journal of Biological Chemistry, 283.27 (Jul. 4, 2008): 19058-19065, 9 Pages.

Harada H., et al., "Antitumor Protein Therapy; Application of the Protein Transduction Domain to the Development of a Protein Drug for Cancer Treatment," Breast Cancer, Jan. 2006, vol. 13, Issue. 1, pp. 16-26, 11 Pages.

Haseeb A., et al., "Immunopathogenesis of Osteoarthritis," Clin Immunol, Mar. 2013, vol. 146, Issue. 3, Epub, Jan. 6, 2013, doi: https://doi.org/10.1016/j.clim.2012.12.011, pp. 185-196.

He X.K., et al., "Low Molecular Weight Hydroxyethyl Chitosan-prednisolone Conjugate for Renal Targeting Therapy: Synthesis, Characterization and In Vivo Studies," Theranostics, 2012, vol. 2(11), pp. 1054-1063, 10 Pages.

Henikoff S., et al., "Amino Acid Substitution Matrices from Protein Blocks," PNAS USA, Nov. 1992, vol. 89 (22), pp. 10915-10919, 5 Pages.

Hermans E., et al., "Phospholipase C Activation by Neurotensin and Neuromedin N in Chinese Hamster Ovary Cells Expressing the Rat Neurotensin Receptor," Molecular Brain Research, Oct. 1992, vol. 15, pp. 332-338, 7 Pages.

Herzig V., et al., "The Cystine Knot Is Responsible for the Exceptional Stability of the Insecticidal Spider Toxin ?-Hexatoxin-Hv1a," Toxins (Basel), Oct. 26, 2015, vol. 7 (10), pp. 4366-4380, 15 Pages.

Hochberg M.C., et al., "American College of Rheumatology 2012 Recommendations for the Use of Non-Pharmacologic and Pharmacologic Therapies in Osteoarthritis of the Hand, Hip and Knee," Arthritis Care Res (Hoboken), Apr. 2012, vol. 64 (4), pp. 465-474, 10 Pages.

Hockaday D.C., et al., "Imaging Glioma Extent with 131I-TM-601," J. Nuc. Med, Apr. 2005, vol. 46 (4), pp. 580-586, 7 Pages.

Hollander J L., "Intrasynovial Corticosteroid Therapy in Arthritis," Md State Med J, Mar. 1970, vol. 19 (3), pp. 62-66, 5 Pages.

Hu Q., et al., "Chondrocyte Affinity Peptide Modified PAMAM Conjugate as a Nanoplatform for Targeting and Retention in Cartilage," Nanomedicine, Mar. 12, 2018, vol. 13 (7), pp. 749-767, 20 Pages.

Huber-Lang M., et al., "Mesenchymal Stem Cells after Polytrauma: Actor and Target," Stem Cells Int, Jun. 2016, 2016:6289825, 11 Pages.

Hunziker E.B., et al., "An Educational Review of Cartilage Repair: Precepts & Practice-Myths & Misconceptions-Progress & Prospects," Osteoarthritis Cartilage, Mar. 2015, vol. 23 (3), pp. 334-350, 17 Pages.

Hwang H.S., et al., "Chondrocyte Apoptosis in the Pathogenesis of Osteoarthritis," Int J Mol Sci, Nov. 2015, vol. 16 (11), pp. 26035-26054, 20 Pages.

"Inhaled Corticosteroids: Are Considered the most Effective Long Term usage Medication for Control and Management of Asthma," URL: https://www.aaaai.org/conditions-and-treatments/treatments/drug-guide/inhaled-corticosteroids. © American Academy of Allergy, Asthma & Immunology, Mar. 7, 2017, 6 pages.

International Preliminary Report on Patentability for Application No. PCT/US2016/051166, dated Mar. 22, 2018, 8 Pages.

International Search Report and Written Opinion Application No. PCT/US2018/023006, dated Jul. 27, 2018, 16 pages.

International Search Report and Written Opinion Application No. PCT/US2018/037544, dated Oct. 26, 2018, 15 pages.

International Search Report and Written Opinion Application No. PCT/US2018/066337, dated Apr. 30, 2019, 13 pages.

International Search Report and Written Opinion Application No. PCT/US2019/022630, dated Jul. 5, 2019, 10 pages.

International Search Report and Written Opinion for Application No. PCT/US16/66007, dated May 24, 2017, 10 pages.

International Search Report and Written Opinion for Application No. PCT/US2016/039431, dated Jan. 13, 2017, 10 pages.

International Search Report for Application No. PCT/US2016/051166, dated Mar. 23, 2017, 5 pages.

IUPHAR/BPS. Guide to Pharmacology—"Tumour necrosis factor (TNF) receptor family," Available at: http://www.guidetopharmacology.org/GRAC/FamilyDisplayForward?familyId-334. Accessed Jul. 11, 2018, 3 pages.

Iyer S., et al., "Tying the Knot: The Cystine Signature and Molecular-Recognition Processes of the Vascular Endothelial Growth Factor Family of Angiogenic Cytokines," The FEBS journal, 2011, vol. 278(22), pp. 4304-4322.

Jain N., et al., "Current ADC Linker Chemistry," Pharmaceutical Research, 2015, vol. 32, No. 11, pp. 3526-3540.

Jang J.Y., et al., "A Nucleic Acid-Hydrolyzing Antibody Penetrates into Cells via Caveolae-Mediated Endocytosis, Localizes in the Cytosol and Exhibits Cytotoxicity," Cell Mol Life Sci, 2009, vol. 66, pp. 1985-1997.

Janzer M., et al., "Drug Conjugation Affects Pharmacokinetics and Specificity of Kidney-Targeted Peptide Carriers," Bioconjugate Chemistry, Sep. 12, 2016, vol. 27, No. 10, pp. 2441-2449.

Jeffrey D., et al., "Intra-Articular Corticosteroids are Safe and Have No. Major Effect on Structural Progression of Synovitic Knee Oa: A 2-Year Randomized Controlled Trial of 3-Monthly Triamcinolone Hexacetonide," 2015 ACR/ARHP Annual Meeting, Sep. 29, 2015, 3 pages.

(56) References Cited

OTHER PUBLICATIONS

Jentoft N., et al., "Labeling of Proteins by Reductive Methylation Using Sodium Cyanoborohydride," Journal of Biological Chemistry, Jan. 17, 1979, vol. 254, pp. 4359-4365.
Jentoft N., et al., "Protein Labeling by Reductive Alkylation," Methods in Enzymology, 1983, vol. 91 (C), pp. 570-579.
Karlsson R., et al., "Analyzing a Kinetic Titration Series Using Affinity Biosensors," Analytical Biochemistry, 2006, vol. 349, pp. 136-147.
Kean W.F., et al., "Clinical Pharmacology of Gold," Inflammopharmacology, Jun. 4, 2008, vol. 16(3), pp. 112-125.
Kern H.B., et al., "Enzyme-Cleavable Polymeric Micelles for the Intracellular Delivery of Proapoptotic Peptides," Molecular Pharmaceutics, May 1, 2017, vol. 14 (5), pp. 1450-1459.
Kikuchi K., et al., "High Proteolytic Resistance of Spider-Derived Inhibitor Cystine Knots," International Journal of Peptide, 2015, 9 pages.
Kim H.T., et al., "Chondrocyte Apoptosis: Implications for Osteochondral Allograft Transplantation," Clin Orthop Relat Res, Aug. 2008, vol. 466 (8), pp. 1819-1825.
Kimura R.H., et al., "Engineered Cystine Knot Peptides that Bind avβ3, avβ5, and a5β1 Integrins with Low-Nanomolar Affinity," Proteins Struct. Funct. Bioinforma, Nov. 1, 2009, vol. 77 (2), pp. 359-369.
Kintizing J.R., et al., "Engineered Knottin Peptides as Diagnostics, Therapeutics, and Drug Delivery Vehicles," Current Opinion in Chemical Biology, 2016, vol. 34, pp. 143-150.
Kirkland J L., "Translating Advances from the Basic Biology of Aging into Clinical Application," Exp Gerontol, Jan. 2013, vol. 48(1), pp. 1-5.
Kirkland J.L., et al., "Clinical Strategies and Animal Models for Developing Senolytic Agents," Exp Gerontol, Aug. 2015, vol. 68, pp. 19-25.
Kirwan J.R., et al., "A Randomised Placebo Controlled 12 Week Trial of Budesonide and Prednisolone in Rheumatoid Arthritis," Annals of the Rheumatic Diseases, Jun. 2004, vol. 63 (6), pp. 688-695.
Kolmar H., "Biological Diversity and Therapeutic Potential of Natural and Engineered Cystine Knot Miniproteins," Current Opinion in Pharmacology, Jun. 10, 2009, vol. 9(5), pp. 608-614.
Kolmar H., "Natural and Engineered Cystine Knot Miniproteins for Diagnostic and Therapeutic Applications," Current Pharmaceutical Design, 2011, vol. 17(38), pp. 4329-4336.
Kozminsky-Atias A., et al., "Isolation of the First Toxin from the Scorpion Buthus Occitanus Israelis Showing Preference for Shaker Potassium Channels," FEBS Letters, 2007, vol. 581(13), pp. 2478-2484.
Krezel A.M., et al., "Solution Structure of the Potassium Channel Inhibitor Agitoxin 2: Caliper for Probing Channel Geometry," Protein Science, 1995, vol. 4(8), pp. 1478-1489.
Kumari G., et al., "Cysteine-Rich Peptide Family with Unusual Disulfide Connectivity from Jasminum Sambac," Journal of Natural Products, 2 5 November 2 015, vol. 7 8(11). pp. 2791-2799.
Kuyinu E.L., et al., "Animal Models of Osteoarthritis: Classification, Update and Measurement of Outcomes," Journal of Orthopaedic Surgery and Research, Feb. 2, 2016, vol. 11(19), 27 pages.
Lal M.A., et al., "Targeting the Podocyte to Treat Glomerular Kidney Disease," Drug Discovery Today, Oct. 10, 2015, vol. 20(10), pp. 1228-1234.
Lange A., et al., "Classical Nuclear Localization Signals: Definition, Function, and Interaction with Importin a*,s," Journal of Biological Chemistry, Feb. 23, 2007, vol. 282(8), pp. 5101-5105.
Larking M.A., et al., "Clustal Wand Clustal X Version 2.0," Bioinformatics Applications Note, 2007, vol. 23(21), pp. 2947-2948.
Li B., et al., "Synergistic Effects of Vascular Endothelial Growth Factor on Bone Morphogenetic Proteins Induced Bone Formation In Vivo: Influencing Factors and Future Research Directions," BioMed Research International, 2016, vol. 2016, Article ID. 2869572, 11 pages.

Li G., et al., "Three Dimensional de Novo Micro Bone Marrow and its Versatile Application in Drug Screening and Regenerative Medicine," Experimental Biology and Medicine (Maywood), Aug. 2015, vol. 240(8), pp. 1029-1038.
Li M.X., et al., "Mitochondria and Apoptosis: Emerging Concepts," F1000Prime Rep, 2015, vol. 7(42), Published online Apr. 1, 2015, 9 pages.
Li Z., et al., "Influence of Molecular Size on Tissue Distribution of Antibody Fragments," MAbs, Jan. 2016, vol. 8(1), pp. 113-119.
Lim K.J., et al., "A Cancer Specific Cell-Penetrating Peptide, BR2, for the Efficient Delivery of an scFv into Cancer Cells," PLoS One, Jun. 2013, vol. 8(6), pp. 1-11.
Ling J., et al., "Molecular Mechanism of the Sea Anemone Toxin ShK Recognizing the Kv1.3 Channel Explored by Docking and Molecular Dynamic Simulations," Journal of Chemical Information and Modeling, 2007, vol. 47, pp. 1967-1972.
Liu Q., et al., "Robust Structural Analysis of Native Biological Macromolecules from MultiCrystal Anomalous Diffraction Data," Acta Crystallographica Section D: Biological Crystallography, 2013, vol. 69(7), pp. 1314-1332.
Liu Y., et al., "Dual Receptor Recognizing Cell Penetrating Peptide for Selective Targeting, Efficient Intratumoral Diffusion and Synthesized Anti-Glioma Therapy," Theranostics, Jan. 1, 2016, vol. 6(2), pp. 177-191.
Lv Z., et al., "HIV Protease Inhibitors: A Review of Molecular Selectivity and Toxicity," HIV AIDS (Auckland), Apr. 8, 2015, vol. 7, pp. 95-104.
Ma D.D., et al., "Engineered Nanoparticles Induce Cell Apoptosis: Potential for Cancer Therapy," Oncotarget, Jun. 28, 2016, vol. 7 (26), pp. 40882-40903.
Macmahon P.J., et al., "Injectable Corticosteroid and Local Anesthetic Preparations: A Review for Radiologists," Radiology, Sep. 2009, vol. 252 (3), pp. 647-661.
Maillere B., et al., "Immunogenicity of a Disulphide-Containing Neurotoxin: Presentation to T-cells Requires a Reduction step," Toxicon, Apr. 1995, vol. 33 (4), pp. 475-482.
Mamelak A.N., et al., "Phase I Single-Dose Study of Intracavitary-Administered Iodine-131-TM-601 in Adults with Recurrent High-Grade Glioma," Journal of Clinical Oncology, Aug. 1, 2006, vol. 24 (22), pp. 3644-3650.
McCoy A.J., et al., "Phaser Crystallographic Software," Journal of Applied Crystallography, Aug. 1, 2007, vol. 40 (pt 4), pp. 658-674.
McNulty A.L., et al., "TRPV4 as a Therapeutic Target for Joint Diseases," Naunyn-Schmiedeberg's Archives of Pharmacology, Apr. 2015, vol. 388 (4), pp. 437-450.
Mehndiratta S., et al., "Quinazolines as Apoptosis Inducers and Inhibitors: A Review of Patent Literature," Recent Patents on Anti-Cancer Drug Discovery, 2016, vol. 11 (1), pp. 2-66.
Mewar D., et al., "Treatment of Rheumatoid Arthritis with Tumour Necrosis Factor Inhibitors," British Journal of Pharmacology, Feb. 2011, vol. 162 (4), pp. 785-791.
Mitchell D.J., et al., "Polyarginine Enters Cells more Efficiently than Other Polycationic Homopolymers," Journal of Peptide Research, Nov. 2000, vol. 56 (5), pp. 318-325.
Mitragotri S., et al., "Overcoming the Challenges in Administering Biopharmaceuticals: Formulation and Delivery Strategies," Nature Reviews Drug Discovery, Sep. 2014, vol. 13(9), pp. 655-672.
Mobasheri A., et al., "Potassium Channels in Articular Chondrocytes," Channels (Austin), Nov. 1, 2012, vol. 6 (6), pp. 416-425.
Mobasheri A., et al., "Potassium Ion Channels in Articular Chondrocytes," Mechanosensitive Ion Channels Mechanosensitivity in Cells and Tissues, vol. 1, 2008, pp. 157-178.
Montagne M., et al., "The Max b-HLH-LZ can Transduce into Cells and Inhibit c-Myc Transcriptional Activities," PLoS One, 2012, vol. 7 (2), p. e32172.
Moore., et al., "Knottins: Disulfide-Bonded Therapeutic and Diagnostic Peptides," Drug Discovery Today: Technologies, Spring 2012, vol. 9, Issue. 1, pp. e3-e11.
Moore S.J., et al., "Engineering Knottins as Novel Binding Agents," Methods in Enzymology, 2012, vol. 503, pp. 223-251.
Moroni G., et al., "Synthetic Pharmacotherapy for Lupus Nephritis," Expert Opinion on Pharmacotherapy, Feb. 2017, vol. 18 (2), pp. 175-186.

(56) References Cited

OTHER PUBLICATIONS

Moroz E., et al., "Oral Delivery of Macromolecular Drugs: Where we are after Almost 100years of Attempts," Advanced Drug Delivery Reviews, Jun. 1, 2016, vol. 101, pp. 108-121.

Mortier E., et al., "Soluble Interleukin-15 Receptor Alpha (IL-15R alpha)-Sushi as a Selective and Potent Agonist of IL-15 Action Through IL-15R Beta/Gamma, Hyperagonist IL-15 x IL-15R alpha Fusion Proteins," Journal of Biological Chemistry, Jan. 20, 2006, vol. 281 (3), pp. 1612-1619.

Mouhat S., et al., "Diversity of Folds in Animal Toxins Acting on Ion Channels," Biochemical Journal, Mar. 2004, vol. 378 (Pt 3), pp. 717-726.

Moura A., et al., "Relative Amino Acid Composition Signatures of Organisms and Environments," PloS one, Oct. 2013, vol. 8 (10), p. e77319.

Moyse E., et al., "Distribution of Neurotensin Binding Sites in Rat Brain: A Light Microscopic Radioautographic Study using Monoiodo [125I]Tyr3-Neurotensin," Neuroscience, Aug. 1987, vol. 22 (2), pp. 525-536.

Mullins L.J., et al., "Renal Disease Pathophysiology and Treatment: Contributions from the Rat," Disease Models & Mechanisms, Dec. 1, 2016, vol. 9 (12), pp. 1419-1433.

Munno D.O., et al., "Effects of Glucocorticoid Treatment on Focal and Systemic Bone Loss in Rheumatoid Arthritis," J Endocrinol Invest, Jul. 2008, vol. 31 (7 Suppl), pp. 43-47.

Murshudov G.N., et al., "Refinement of Macromolecular Structures by the Maximum-likelihood Method," Acta Crystallographica Section D, May 1, 1997, D53, pp. 240-255.

Mustain W.C., et al., "The Role of Neurotensin in Physiologic and Pathologic Processes," Current Opinion in Endocrinology, Diabetes and Obesity, Feb. 2011, vol. 18(1), pp. 75-82.

Musumeci G., et al., "Biomarkers of Chondrocyte Apoptosis and Autophagy in Osteoarthritis," International Journal of Molecular Sciences, Aug. 31, 2015, vol. 16(9), pp. 20560-20575.

Myszka D.G., "Improving Biosensor Analysis," Journal of Molecular Recognition, Sep.-Oct. 1999, vol. 12(5), pp. 279-284.

Nagase H., "Substrate Specificity of MMPs," Chapter 2, Matrix Metalloproteinase Inhibitors in Cancer Therapy, Cancer Drug Discovery and Development, Humana Press, Totowa, NJ, 2001, pp. 39-66.

Nayak A., et al., "In Vitro and In Vivo Study of Poly (ethylene glycol) Conjugated Ibuprofen to Extend the Duration of Action," Scientia Pharmaceutica, Apr.-Jun. 2011, vol. 79(2), pp. 359-373.

Needleman S.B., et al., "A General Method Applicable to the Search for Similarities in the Amino Acid Sequence of two Proteins," Journal of Molecular Biology, Mar. 28, 1970, vol. 48(3), pp. 443-453.

Nelson A.R., et al., "Myristoyl-Based Transport of Peptides into Living Cells," Biochemistry, Dec. 25, 2007, vol. 46(51), pp. 14771-14781.

Nicolaides N.C., et al., "Glucocorticoid Therapy and Adrenal Suppression," Endotext, South Dartmouth, MA, MDText com, Incorporated, 2000, 26 Pages.

Nielsen M., et al., "NN-Align. An Artificial Neural Network-Based Alignment Algorithm for MHC Class II Peptide Binding Prediction," BMC Bioinformatics, Sep. 18, 2009, vol. 10(296), 10 Pages.

Nielsen M., et al., "Prediction of MHC Class II Binding Affinity Using SMM-Align, A Novel Stabilization Matrix Alignment Method," BMC Bioinformatics, Jul. 4, 2007, vol. 8(238), 12 Pages.

Njiojob C.N., et al., "Tailored Near-Infrared Contrast Agents for Image Guided Surgery," Journal of Medicinal Chemistry, Mar. 26, 2015, vol. 58(6), pp. 2845-2854.

Oh C.J., et al., "Dimethylfumarate Attenuates Renal Fibrosis via NF-E2-Related Factor 2-Mediated Inhibition of Transforming Growth Factor-β/Smad Signaling," PLOS One, Oct. 2012, vol. 7(10), e45870.

Ojeda P.G., et al., "Lysine to Arginine Mutagenesis of Chlorotoxin Enhances its Cellular Uptake," Biopolymers, Sep. 2017, vol. 108(5), 10 pages.

Ojeda P.G., et al., "Review: Chlorotoxin: Structure, Activity, and Potential Uses in Cancer Therapy," Biopolymers, Jan. 1, 2016, vol. 106(1), pp. 25-36.

Otwinowski Z., et al., "Processing of X-ray Diffraction Data Collected in Oscillation Mode," Methods in Enzymology, 1997, vol. 276, pp. 307-326.

Park M.S., et al., "In Situ Recruitment of Human Bone Marrow-Derived Mesenchymal Stem Cells Using Chemokines for Articular Cartilage Regeneration," Cell Transplantation, 2015, vol. 24(6), pp. 1067-1083.

Pearson W.R., et al., "Improved Tools for Biological Sequence Comparison," Proceedings of the National Academy of Sciences of the United States of America, Apr. 1988, vol. 85(8), pp. 2444-2448.

Pearson W.R., "Rapid and Sensitive Sequence Comparison with FASTP and FASTA," Methods in Enzymology, 1990, vol. 183, pp. 63-98.

Pi Y., et al., "Targeted Delivery of Non-Viral Vectors to Cartilage in Vivo Using a Chondrocyte-Homing Peptide Identified by Phage Display," Biomaterials, Sep. 2011, vol. 32(26), pp. 6324-6332.

Pillow T.H., et al., "Site-Specific Trastuzumab Maytansinoid Antibody-Drug Conjugates with Improved Therapeutic Activity Through Linker and Antibody Engineering," Journal of Medicinal Chemistry, Oct. 9, 2014, vol. 57(19), pp. 7890-7899.

Plosker G.L., et al. "Sulfasalazine: A Review of its Use in The Management of Rheumatoid Arthritis," Drugs, Jan. 1, 2005, vol. 65(13), pp. 1825-1849.

Poillot C., et al., "Small Efficient Cell-Penetrating Peptides Derived from Scorpion Toxin Maurocalcine," Journal of Biological Chemistry, May 18, 2012, vol. 287(21), pp. 17331-17342.

Ponce A., "Expression of Voltage Dependent Potassium Currents in Freshly Dissociated Rat Articular Chondrocytes," Cellular Physiology and Biochemistry, Aug. 14, 2006, vol. 18(1-3), pp. 35-46.

Pooga M., et al., "Cell Penetration by Transportan," Faseb Journal, Jan. 1998, vol. 12(1), pp. 67-77.

Portilla D., "Apoptosis, Fibrosis and Senescence," Nephron Clinical Practice, 2014, vol. 127(1-4), pp. 65-69.

Portilla D., et al., "Metabolomic Study of Cisplatin-Induced Nephrotoxicity," Kidney International, Jun. 2006, vol. 69(12), pp. 2194-2204.

Potterton E., et al., "A Graphical User Interface to the CCP4 Program Suite," Acta Crystallographica, Jul. 2003, vol. 59(7), pp. 1131-1137.

Pouyani T., et al., "Functionalized Derivatives of Hyaluronic Acid Oligosaccharides: Drug Carriers and Novel Biomaterials," Bioconjugate Chemistry, Jul.-Aug. 1994, vol. 5(4), pp. 339-347.

Procko., et al., "A Computationally Designed Inhibitor of an Epstein-Barr Viral Bcl-2 Protein Induces Apoptosis in Infected Cells," Cell, Jun. 19, 2014, vol. 157(7), pp. 1644-1656.

Punzi L., et al., "Post-Traumatic Arthritis: Overview on Pathogenic Mechanisms and Role of Inflammation," RMD Open, Sep. 6, 2016, vol. 2(2), e000279, 9 pages.

Qian Z., et al., "Early Endosomal Escape of a Cyclic Cell-Penetrating Peptide Allows Effective Cytosolic Cargo Delivery," Biochemistry. Jun. 24, 2014, vol. 53(24), pp. 4034-4046.

Quintas-Cardama A., et al., "Molecular Pathways: JAK/STAT Pathway: Mutations, Inhibitors, and Resistance," Clinical Cancer Research, Apr. 15, 2013, vol. 19(8), pp. 1933-1940.

Ramos A.M., et al., "Designing Drugs that Combat Kidney Damage," Expert Opinion on Drug Discovery, May 2015, vol. 10(5), pp. 541-556.

Rashid M.H., et al., "A Potent and Kv1.3-Selective Analogue of The Scorpion Toxin HsTX1 as a Potential Therapeutic for Autoimmune Diseases," Scientific Reports, Mar. 28, 2014, vol. 4(4509), pp. 1-9.

Rau R., "Glucocorticoid Treatment in Rheumatoid Arthritis," Expert Opinion on Pharmacotheraphy, Aug. 2014, vol. 15(11), pp. 1575-1583.

Raynauld J-P., et al., "Safety And Efficacy of Long-Term Intraarticular Steroid Injections in Osteoarthritis of the Knee: A Randomized, Double-Blind, Placebo-Controlled Trial," Arthritis & Rheumatology, Feb. 2003, vol. 48(2), pp. 370-377.

Rees D.C., et al., "Refined Crystal Structure of the Potato Inhibitor Complex of Carboxypeptidase A at 2.5 A Resolution," Journal of Molecular Biology, Sep. 25, 1982, vol. 160(3), pp. 475-498.

(56) References Cited

OTHER PUBLICATIONS

Reines B.P., "Is Rheumatoid Arthritis Premature Osteoarthritis with Fetal-Like Healing?," Autoimmune Review, Jun. 2004, vol. 3(4), pp. 305-311.
Reinwarth M., et al., "Chemical Synthesis, Backbone Cyclization and Oxidative Folding of Cystine-Knot Peptides-Promising Scaffolds for Applications In Drug Design," Molecules, Oct. 24, 2012, vol. 17(11), pp. 12533-12552.
Ren J., et al., "Quercetin Inhibits Fibroblast Activation and Kidney Fibrosis Involving The Suppression of Mammalian Target of Rapamycin and Beta-Catenin Signaling," Scientific Reports, Apr. 7, 2016, vol. 6(23968), 11 pages.
Renisio J-G., et al., "Solution Structure of BmKTX, a K+ Blocker Toxin from The Chinese Scorpion Buthus Martensi," Proteins: Structure, Function and Genetics, Jan. 1, 2000, vol. 38(1), pp. 70-78.
Rhee M., et al., "Mechanism of Uptake of C105Y, A Novel Cell-Penetrating Peptide," Journal of Biological Chemistry, Jan. 13, 2006, vol. 281(2), pp. 1233-1240.
Ricci M.C., et al., "Chemotherapeutic Approaches for Targeting Cell Death Pathways," Oncologist, Apr. 2006, vol. 11(4), pp. 342-357.
Rice P., et al., "Emboss: The European Molecular Biology Open Software Suite," Trends in Genetics, Jun. 2000, vol. 16(6), pp. 276-277.
Rossini M., et al., "Focal Bone Involvement In Inflammatory Arthritis: The Role of IL17," Rheumatology International, Apr. 2016, vol. 36(4), pp. 469-482.
Said E.A., et al., "The Anti-Hiv Cytokine Midkine Binds The Cell Surface-Expressed Nucleolin As A Low Affinity Receptor," Journal of Biological Chemistry, Oct. 4, 2002, vol. 277 (40), pp. 37492-37502.
Samy R.P., et al.."Animal Venoms As Antimicrobial Agents," Biochem Pharmacology, Jun. 15, 2017, vol. 134, pp. 127-138.
Sangphukieo A., et al., "Computational Design of Hypothetical New Peptides Based on a Cyclotide Scaffold as HivGp120 Inhibitor," Plos One 10, Oct. 30, 2015, vol. 10 (11), 15 Pages.
Sansone P., et al., "Targeting The Interleukin-6/Jak/Stat Pathway In Human Malignancies," Journal of Clinical Oncology , Mar. 20, 2012, vol. 30, pp. 1005-1014.
Santos S.P., et al., "Thermofluor-based Optimization Strategy for the Stabilization and Crystallization of Campylobacter Jejuni Desulforubrerythrin," Protein Expression and Purification, 2012, vol. 81, pp. 193-200.
Schmidt T.J., et al., "Reactivity of Dimethyl Fumarate and Methylhydrogen Fumarate Towards Glutathione and N-Acetyl-L-Cysteine-Preparation of S-Substituted Thiosuccinic Acid Esters," Bioorganic & Medicinal Chemistry, Jan. 1, 2007, vol. 15 (1), pp. 333-342.
Schwartz E.F., et al., "Characterization of Hadrucalcin, A Peptide from Hadrurus Gertschi Scorpion Venom With Pharmacological Activity On Ryanodine Receptors," British Journal of Pharmacology, Jun. 2009, vol. 157 (3), pp. 392-403.
Sellers P.H., et al., "On The Theory and Computation of Evolutionary Distances," Siam Journal On Applied Mathematics, Jun. 1974, vol. 26 (4), pp. 787.
Shahbazzadeh D., et al., "Hemicalcin, A New Toxin from The Iranian Scorpion Hemiscorpius Lepturus Which Is Active On Ryanodine-Sensitive Ca2+ Channels," Biochemical Journal, 2007, vol. 404, pp. 89-96.
Shao B-Z., et al., "Nlrp3 Inflammasome and Its Inhibitors: A Review," Frontiers in Pharmacology, Nov. 2015, vol. 6, pp. 262.
Shen J., et al., "Nlrp3 Inflammasome Mediates Contrast Media-Induced Acute Kidney Injury By Regulating Cell Apoptosis," Scientific Reports 6, Article No. 34682, 2016, 10 Pages.
Shen X., et al., "Prolyl Hydroxylase Inhibitors Increase Neoangiogenesis and Callus formation Following Femur Fracture In Mice," Journal of Orthopaedic Research, Oct. 2009, vol. 27 (10), pp. 1298-1305.
Shimoaka T., et al., "Regulation of Osteoblast, Chondrocyte, and Osteoclast Functions By Fibroblast Growth Factor (Fgf)-18 In Comparison With Fgf-2 and Fgf-10," Journal of Biological Chemistry, Mar. 1, 2002, vol. 277 (9), pp. 7493-7500.
Shire S.J., et al., "Challenges in The Development of High Protein Concentration formulations," Journal of Pharmaceutical Sciences, 2004, vol. 93 (6), pp. 1390-1402.
Sillero A., et al., "Isoelectric Point Determination of Proteins and Other Macromolecules: Oscillating Method," Computers in Biology and Medicine, Feb. 2006, vol. 36 (2), pp. 157-166.
Sillero A., et al., "Isoelectric Points of Proteins: Theoretical Determination," Analytical Biochemistry, Jun. 1989, vol. 179 (2), pp. 319-325.
Simeon R., et al., "In Vitro-Engineered Non-Antibody Protein Therapeutics," Protein Cell, 2018, vol. 9(1), pp. 3-14.
Singh S.K., et al., "Antibody-Drug Conjugates: Design, formulation and Physicochemical Stability," Pharmaceutical Research, Nov. 2015, vol. 32 (11), pp. 3541-3571.
Sinha V.R., et al., "Oral Colon-Specific Drug Delivery of Protein and Peptide Drugs," Critical Review in Therapeutic Drug Carrier Systems, 2007, vol. 24 (1), pp. 63-92.
Sinniah R., et al., "Serum Iron, Total Iron-Binding Capacity, and Percentage Saturation In Normal Subjects," Journal of Clinical Pathology, 1968, vol. 21, pp. 603-610.
Solon E G., "Autoradiography Techniques and Quantification of Drug Distribution," Cell and Tissue Research, 2015, vol. 360 (1), pp. 87-107.
Song Y., et al., "Small-Molecule Modulators of The Ox40-Ox40 Ligand Co-Stimulatory Protein-Protein Interaction," British Journal of Pharmacology, Nov. 2014, vol. 171 (21), pp. 4955-4969.
Soroceanu L., et al., "Use of Chlorotoxin for Targeting of Primary Brain Tumors," Cancer Research, Nov. 1, 1998, vol. 58 (21), pp. 4871-4879.
Sottero T.L., et al., "Pacifastin-Derived Peptides Target Tumors for Use In In Vivo Imaging," Anticancer Research, Jan. 2018, vol. 38 (1), pp. 51-60.
Steinert A.F., et al., "Major Biological Obstacles for Persistent Cell-Based Regeneration of Articular Cartilage," Arthritis Research & Therapy, Jun. 5, 2007, vol. 9 (3), 15 pages.
Stern L.A., et al., "Alternative Non-Antibody Protein Scaffolds for Molecular Imaging of Cancer," Current Opinion In Chemical Engineering, Nov. 2013, vol. 2 (4), 15 pages.
Sudo K., et al., "Human-Derived Fusogenic Peptides for The Intracellular Delivery of Proteins," Journal of Controlled Release, Jun. 10, 2017, vol. 255, pp. 1-11.
Sugumar D., et al., "Targeted Treatments for Multiple Myeloma: Specific Role of Carfilzomib," Pharmacogenomics and Personalized Medicine, Jan. 20, 2015, vol. 8, pp. 23-33.
Sutherland R., et al., "Ubiquitous Cell-Surface Glycoprotein On Tumor Cells Is Proliferation-Associated Receptor for Transferrin," Proceedings of the National Academy of Sciences of the United States of America, Jul. 1981, vol. 78 (7), pp. 4515-4519.
Swanson C.D.A., et al., "Tyrosine Kinases As Targets for The Treatment of Rheumatoid Arthritis," Nature Reviews Rheumatology, Jun. 2009, vol. 5 (6), pp. 317-324.
Tabrizi M., et al., "Biodistribution Mechanisms of Therapeutic Monoclonal Antibodies In Health and Disease," An Official Journal of the American Association of Pharmaceutical Scientists, Mar. 2010, vol. 12 (1), pp. 33-43.
Tait S.W.G., et al., "Die Another Way-Non-Apoptotic Mechanisms of Cell Death," Journal Cell Science, May 15, 2014, vol. 127 (10), pp. 2135-2144.
Takayama K., et al., "Enhanced Intracellular Delivery Using Arginine-Rich Peptides By The Addition of Penetration Accelerating Sequences (Pas)," Journal of Control Release, Sep. 1, 2009, vol. 138 (2), pp. 128-133.
Tam J.P., et al., "Antimicrobial Peptides from Plants," Pharmaceuticals, Dec. 2015, vol. 8 (4), pp. 711-757.
Tangri S., et al., "Rationally Engineered Proteins Or Antibodies With Absent Or Reduced Immunogenicity," Current Medicinal Chemistry, Dec. 2002, vol. 9 (24), pp. 2191-2199.
Tesmer J.J., et al., "The Structure, Catalytic Mechanism and Regulation of Adenylyl Cyclase," Current Opinion in Structural Biology, Dec. 1998, vol. 8 (6), pp. 713-719.

(56) References Cited

OTHER PUBLICATIONS

The Extended European Search Report for European application, No. EP16845226.6 dated Mar. 28, 2019.
The Extended European Search Report for European application, No. EP16874006.6 dated Jul. 30, 2019.
The Extended European Search Report for European application, No. EP17849695.6 dated Apr. 1, 2020.
The Extended European Search Report for European application, No. EP18767105.2 dated Nov. 24, 2020, 13 Pages.
The partial Supplemental European Search Report for European application, No. EP16874006.6 dated Apr. 24, 2019.
The Uniprot Consortium, "Uniprot: The Universal Protein Knowledgebase," Nucleic Acids Research, 2017, vol. 45, pp. D158-D169.
Trenevska I., et al., "Therapeutic Antibodies Against Intracellular Tumor Antigens," Frontiers in Immunology, Aug. 18, 2017, vol. 8 (article 1001), pp. 1001.
Trudeau L E., "Neurotensin Regulates Intracellular Calcium In Ventral Tegmental Area Astrocytes: Evidence for The Involvement of Multiple Receptors," Neuroscience, 2000, vol. 97 (2), pp. 293-302.
Tsunemi M., et al., "Crystallization of A Complex Between An Elastase-Specific Inhibitor Elafin and Porcine Pancreatic Elastase," Journal of Molecular Biology, Jul. 1993, vol. 232 (1), pp. 310-311.
Tundo G.R., et al., "Effect of Cisplatin on Proteasome Activity," Journal of Inorganic Biochemistry, Dec. 2015, vol. 153, pp. 253-258.
Ueda N., "Ceramide-Induced Apoptosis in Renal Tubular Cells: A Role of Mitochondria and Sphingosine-1-Phoshate," International Journal of Molecular Sciences, Mar. 5, 2015, vol. 16(3), pp. 5076-5124.
Van Den Hoven J.M., et al., "Optimizing The Therapeutic Index of Liposomal Glucocorticoids In Experimental Arthritis," International Journal of Pharmaceutics, Sep. 20, 2011, vol. 416(2), pp. 471-477.
Van Walsem A., et al., "Relative Benefit-Risk Comparing Diclofenac To Other Traditional Non-Steroidal Anti-Inflammatory Drugs and Cyclooxygenase-2 Inhibitors In Patients With Osteoarthritis Or Rheumatoid Arthritis: A Network Meta-Analysis," Arthritis Research Therapy, Mar. 19, 2015, vol. 17(66), 18 Pages.
Vannucci G., et al., "Glucocorticoids In The Management of Systemic Juvenile Idiopathic Arthritis," Paediatric Drugs, Oct. 2013, vol. 15(5), pp. 343-349.
Varoga D., et al., "Human Beta-Defensin 3 Mediates Tissue Remodeling Processes In Articular Cartilage By Increasing Levels of Metalloproteinases and Reducing Levels of Their Endogenous Inhibitors," Arthritis and Rheumatism, Jun. 2005, vol. 52(6), pp. 1736-1745.
Varoga D., et al., "Production of Endogenous Antibiotics In Articular Cartilage," Arthritis and Rheumatism, Nov. 2004, vol. 50(11), pp. 3526-3534.
Vasalou C., et al., "A Mechanistic Tumor Penetration Model To Guide Antibody Drug Conjugate Design," Plos One, ADC Tumor Penetration, Mar. 18, 2015, vol. 10(3), pp. 1-20, E0118977.
Veiseh M., et al., "Tumor Paint: A Chlorotoxin:Cy5.5 Bioconjugate for Intraoperative Visualization of Cancer Foci," Cancer Research, Jul. 15, 2007, vol. 67(14), pp. 6882-6888.
Vincent J-P., et al., "Neurotensin and Neurotensin Receptors," Trends Pharmacological Science, Jul. 1, 1999, vol. 20(7), pp. 302-309.
Vitt U.A., et al., "Evolution and Classification of Cystine Knot-Containing Hormones and Related Extracellular Signaling Molecules," Molecular Endocrinology, May 1, 2001, vol. 15(5), pp. 681-694.
Vives E., et al., "A Truncated HIV-1 Tat Protein Basic Domain Rapidly Translocates Through The Plasma Membrane and Accumulates In The Cell Nucleus," The Journal of Biological Chemistry, Jun. 20, 1997, vol. 272(25), pp. 16010-16017.
Vordenbaumen S., et al., "Defensins Potential Effectors Autoimmune Rheumatic Disorders," Polymers, 2011, vol. 3, pp. 1268-1281.
Vyas S., et al. "Ketorolac-Dextran Conjugates: Synthesis, in Vitro and in Vivo Evaluation," Acta Pharmaceutica, Dec. 2007, vol. 57(4), pp. 441-450.
Wakankar A.A., et al., "Formulation Considerations for Proteins Susceptible To Asparagine Deamidation and Aspartate Isomerization," Journal of Pharmaceutical Sciences, Nov. 2006, vol. 95(11), pp. 2321-2336.
Wan L., et al., "Epo Promotes Bone Repair Through Enhanced Cartilaginous Callus formation and Angiogenesis," Plos One, EPO in Skeletal Regeneration, Jul. 2014, vol. 9(7), 10 Pages, E102010.
Wang P., et al., "Flavonoid Compound Icariin Activates Hypoxia Inducible Factor-1 Alpha in Chondrocytes and Promotes Articular Cartilage Repair," Plos One, Feb. 3, 2016, vol. 11(2), 24 Pages, E0148372.
Wang W., et al., "Annexin-Mediated Ca2+ Influx Regulates Growth Plate Chondrocyte Maturation and Apoptosis," The Journal of Biological Chemistry, Feb. 7, 2003, vol. 278(6), pp. 3762-3769.
Wang X., et al., "Characterization of Promoter Elements Regulating The Expression of The Human Neurotensin/Neuromedin N Gene," The Journal of Biological Chemistry, Jan. 7, 2011, vol. 286(1), pp. 542-554.
Ward M.M., et al., "American College of Rheumatology/Spondylitis Association of America/Spondyloarthritis Research and Treatment Network 2015 Recommendations for The Treatment of Ankylosing Spondylitis and Nonradiographic Axial Spondyloarthritis," Arthritis Rheumatol, Feb. 2016, vol. 68(2), pp. 282-298.
Weatherall K.L., et al., "Small Conductance Calcium-Activated Potassium Channels: from Structure to Function," Progress in Neurobiology, Jul. 2010, vol. 91(3), pp. 242-255.
Werle M., et al., "The Potential of Cystine-Knot Microproteins As Novel Pharmacophoric Scaffolds In Oral Peptide Drug Delivery," Journal of Drug Targeting, Apr. 2006, vol. 14(3), pp. 137-146.
Winn M.D., et al., "Overview of the CCP4 Suite and Current Developments," Acta Crystallographica Section D, Biological Crystallography, 2011, D67, pp. 235-242.
Winnard P.T., et al., "Development of Novel Chimeric Transmembrane Proteins for Multimodality Imaging of Cancer Cells," Cancer Biology and Therapy, Dec. 2007, vol. 6(12), pp. 1889-1899.
Wiranowska M., et al., "Clathrin-Mediated Entry and Cellular Localization of Chlorotoxin in Human Glioma," Cancer Cell International, Aug. 12, 2011, vol. 11:27, 13 pages.
Wischnjow A., et al., "Renal Targeting: Peptide-Based Drug Delivery to Proximal Tubule Cells," Bioconjugate Chemistry, Apr. 20, 2016, vol. 27(4), pp. 1050-1057. doi: 10.1021/acs.bioconjchem.6b00057. Epub Mar. 30, 2016.
Wojdasiewicz P., et al., "The Role of Inflammatory and Anti-Inflammatory Cytokines in the Pathogenesis of Osteoarthritis," Mediators of Inflammation. vol. 2014 (2014), Article ID 561459, 19 pages, http://dx.doi.org/10.1155/2014/561459.
Xiao Z., et al., "Mechanisms of Cyclosporine-Induced Renal Cell Apoptosis: A Systematic Review," American Journal of Nephrology, 2013, vol. 37, pp. 30-40, https://doi.0rg/10.1159/000345988.
Yamada., et al., "Internalization of Bacterial Redox Protein Azurin in Mammalian Cells: Entry domain and specificity," Cellular Microbiology, 2005, vol. 7(10), pp. 1418-1431.
Yang J., et al., "The I-TASSER Suite: Protein Structure and function Prediction," Nature Methods, Jan. 2015, vol. 12(1), pp. 7-8.
Yang M., et al., "Protein-peptide Interactions Analyzed with the Yeast Two-Hybrid System," Nucleic Acids Research, 1995, vol. 23 No. 7, pp. 1152-1156.
Ye F., et al., "The Scorpion Toxin Analogue BmKTX-D33H as a Potential Kv1. 3 Channel-selective Immunomodulator for Autoimmune Diseases," Toxins, 2016, vol. 8(4), pp. 115.
Yu R.Y., et al., "A Naturally Occurring, Soluble Antagonist of Human IL-23 Inhibits the Development and In vitro Function of human Th17 Cells," Journal Immunology, Dec. 15, 2010, vol. 185(12), pp. 7302-7308, doi: 10.4049/jimmunol.1002410, Epub Nov. 12, 2010.

(56) References Cited

OTHER PUBLICATIONS

Yurkovetskiy A.V., et al., "A Polymer-Based Antibody-Vinca Drug Conjugate Platform: Characterization and Preclinical Efficacy," Cancer Research, Aug. 15, 2015, vol. 75(16), pp. 3365-3372.

Zager R.A., "Marked Protection Against Acute Renal and Hepatic Injury after Nitrited Myoglobin+ tin Protoporphyrin Administration," Translational Research, 2015, vol. 166(5), pp. 485-501.

Zamli Z., et al., "Chondrocyte Apoptosis: A Cause or Consequence of Osteoarthritis?," International Journal of Rheumatic Diseases, May 2011, vol. 14(2), pp. 159-166, doi: 10.1111 /j. 1756-185X. 2011.01618.x.

Zhang H., et al., "Tumor-Selective Proteotoxicity of Verteporfin Inhibits Colon Cancer Progression Independently of YAP1," Science Signaling, Oct. 6, 2015, vol. 8, Issue. 397(ra98), 13 pages.

Zhang Z., et al., "The Functions of BMP3 in Rabbit Articular Cartilage Repair," International Journal of Molecular Sciences, Oct. 29, 2015, vol. 16(11), pp. 25934-25946, doi:10.3390/ijms161125937.

Zhao Y., et al., "Chemical Engineering of Cell Penetrating Antibodies," Journal of Immunological Methods, 2001, vol. 254, pp. 137-145.

Zhou Y., et al., "Kidney-targeted Drug Delivery Systems," Acta Pharmaceutica Sinica B, Feb. 2014, vol. 4(1), pp. 37-42, Published online Jan. 23, 2014, doi: 10.1016/j.apsb.2013.12.005.

Zhu Y., et al., "Evolutionary Origin of Inhibitor Cystine Knot Peptides," FASEB Journal, vol. 17, Jul. 3, 2003, pp. 1765-1767.

Zhu Y., et al., "Identification of a Novel Senolytic Agent, Navitoclax, Targeting the Bcl-2 family of Anti-apoptotic Factors," Aging Cell, Jun. 15, 2016, vol. 15(3), pp. 428-435, Epub Mar. 18, 2016.

Zhu Y., et al., "Precursor Nucleotide Sequence and Genomic Organization of BmTXKSI, A New Scorpion Toxin-like Peptide from Buthus martensii Karsch," Toxicon, Sep. 2001, vol. 39(9), pp. 1291-1296.

Zhu Y., et al., "The Achilles' Heel of Senescent Cells: from Transcriptome to Senolytic Drugs," Aging Cell, Aug. 2015, vol. 14(4), pp. 644-658, Epub Apr. 22, 2015.

Kosaka N., et al., "Near Infrared Fluorescence-Guided Real-Time Endoscopic Detection of Peritoneal Ovarian Dancer Nodules Using Intravenously Injected Indocyanine Green," International Journal of Cancer, 2011, vol. 129, pp. 1671-1677.

McGonigle S., et al., "Neuropilin-1 Drives Tumor-Specific Uptake of Chlorotoxin," Cell Communication and Signaling, 2019, vol. 17, No. 1, 67, 14 pages.

Wikipedia: "Indocyanine Green," The WayBack Machine, Accessed on Apr. 6, 2022, 6 pages, Retrieved from the Internet: https://web.archive.org/web/20120628074147/https://en.wikipedia.org/wiki/Indocyanine_green.

Strickland, Tumor Detection in Nonstationary Backgrounds IEEE Transactions on Medical Imaging 13(3): 491-499 (Sep. 1994).

Thurber et al., Detection Limits of Intraoperative Near Infrared Imaging for Tumor Resection. Journal of Surgical Oncology 102: 758-764 (Sep. 24, 2010).

Van Dam et al., Intraoperative tumor-specific fluorescence imaging in ovarian cancer by folate receptor-alpha targeting: first in human results. Nature Medicine 17(10): 1315-1319 (Oct. 2011).

Moon et al., Enhanced Tumor Detection Using a Folate Receptor-Targeted Near-Infrared Fluorochrome Conjugate. Bioconjugate Chem 14: 539-545 (May 1, 2003).

\* cited by examiner

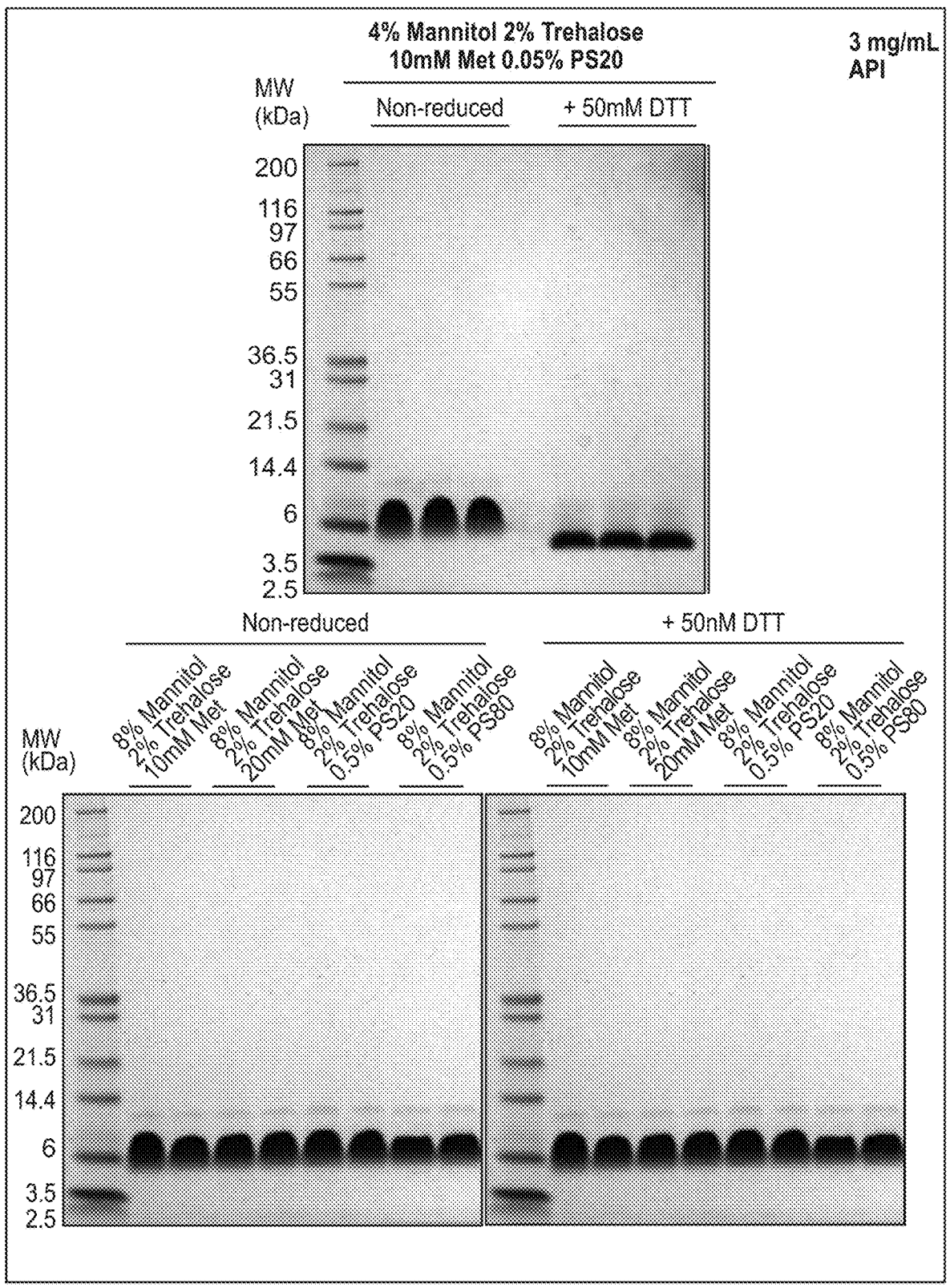
FIG. 6 (Cont. 1)

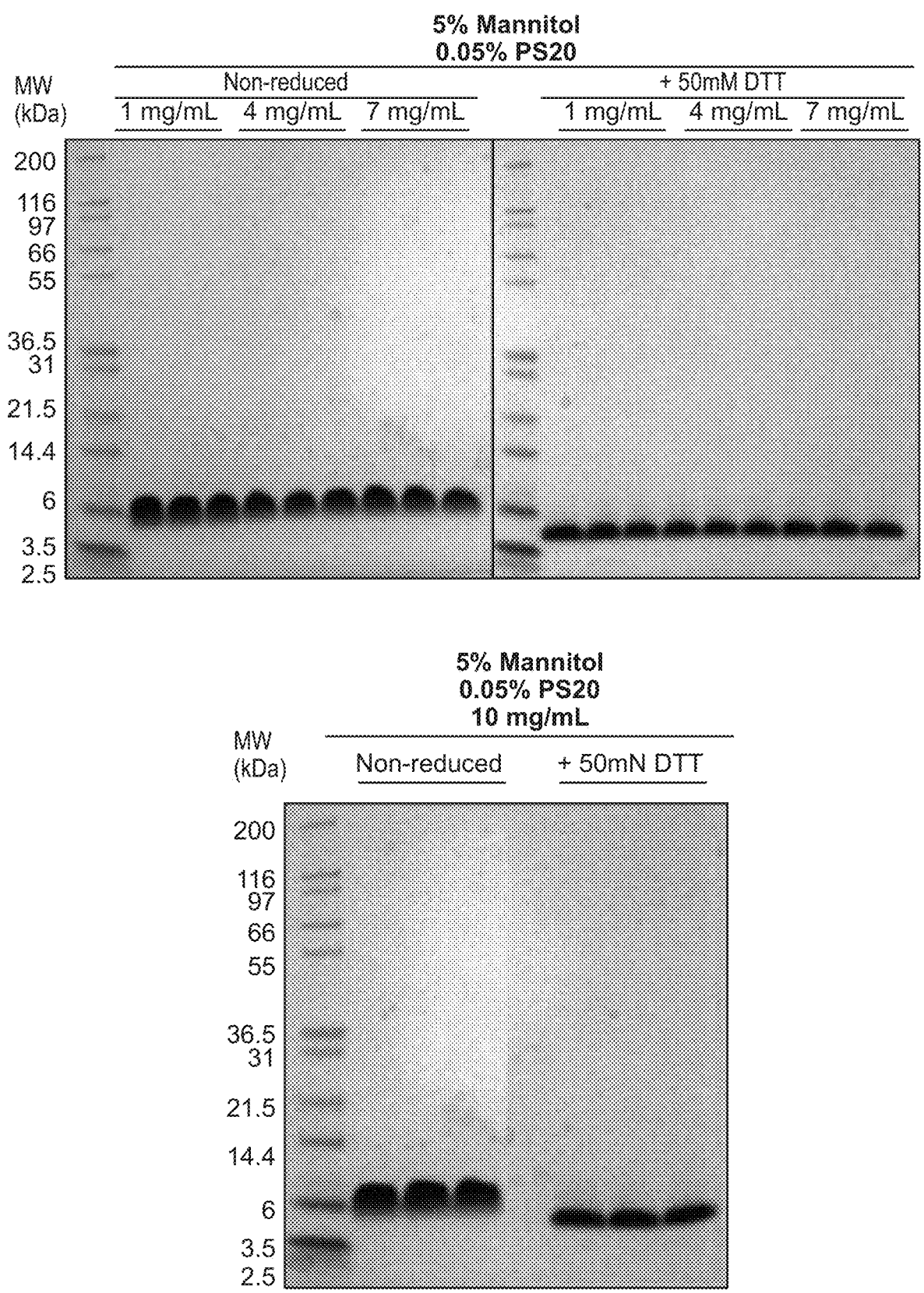
FIG. 6 (Cont. 2)

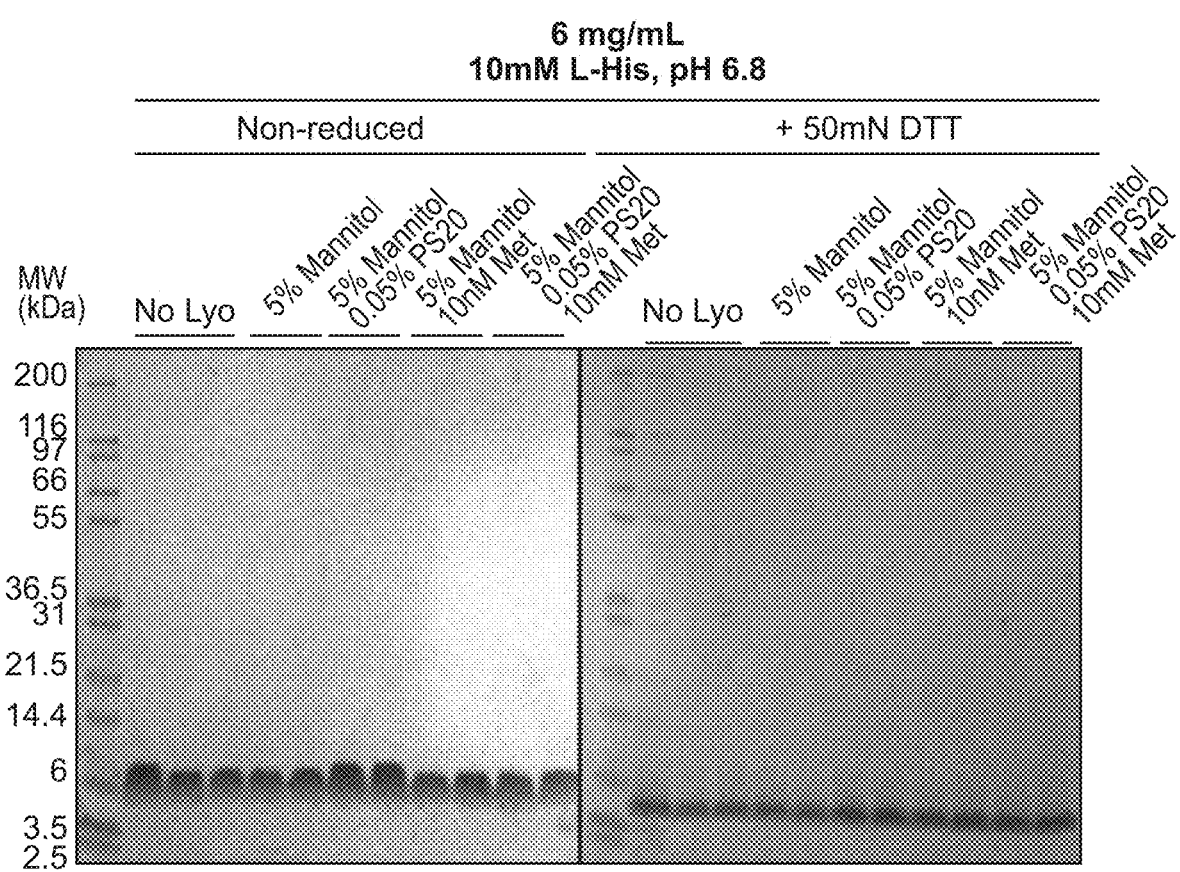
FIG. 6 (Cont. 3)

FIG. 10A
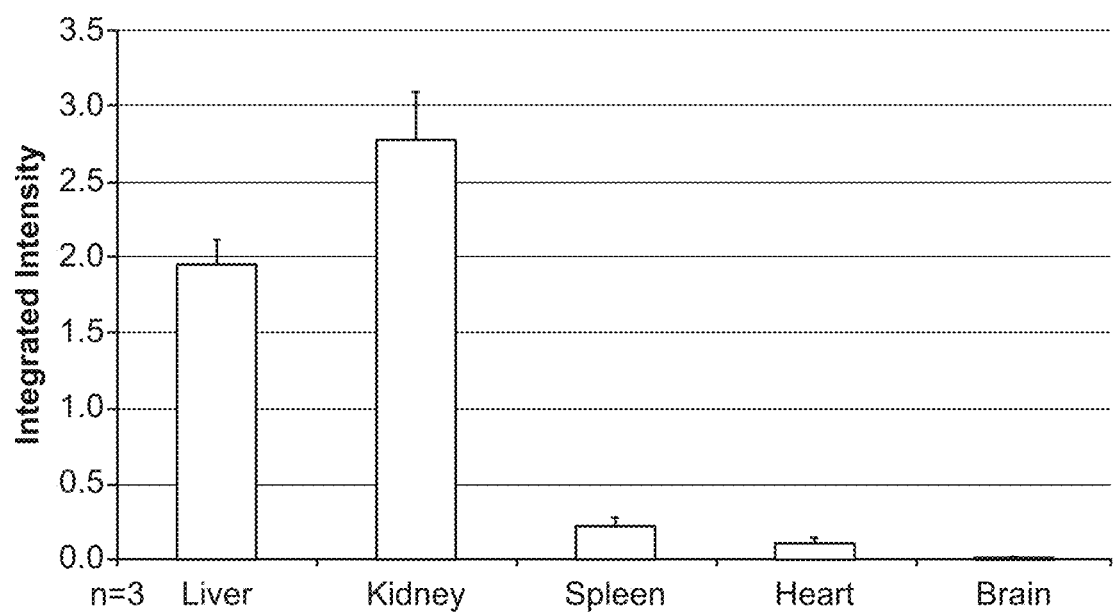
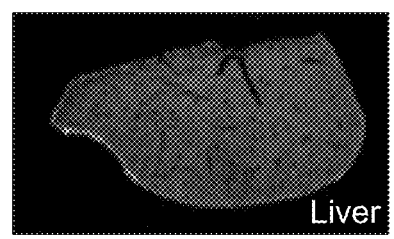
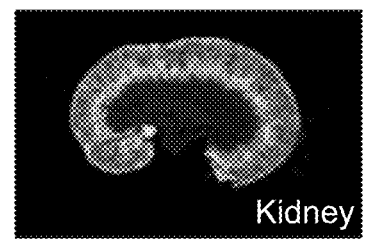
FIG. 10B        FIG. 10C

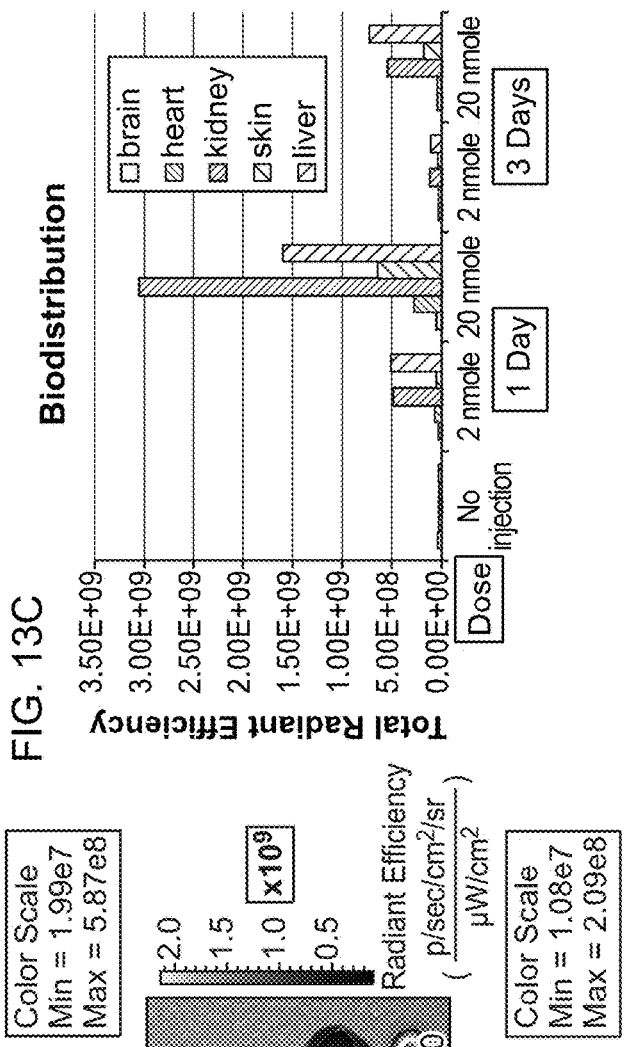
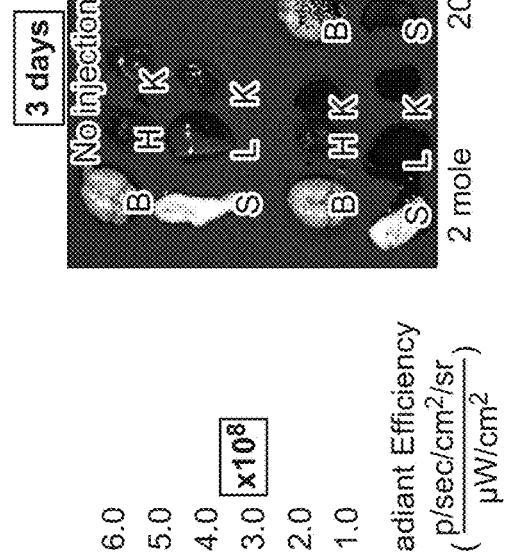
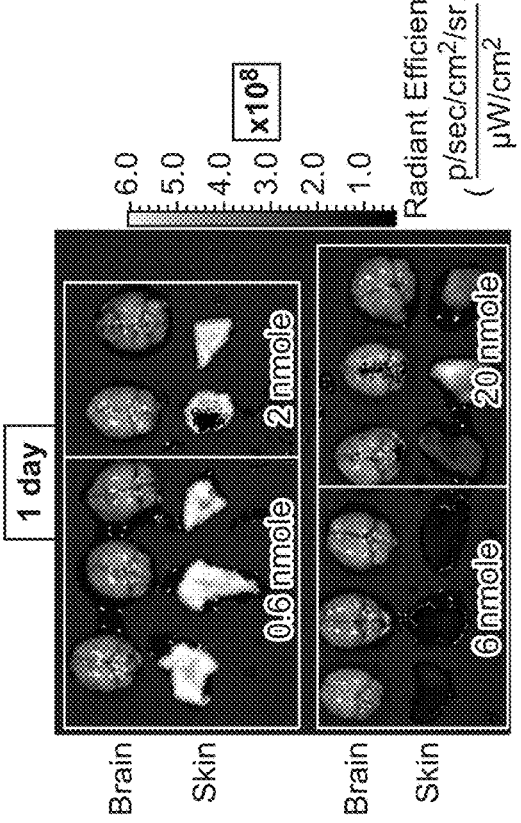
FIG. 13A
FIG. 13B
FIG. 13C

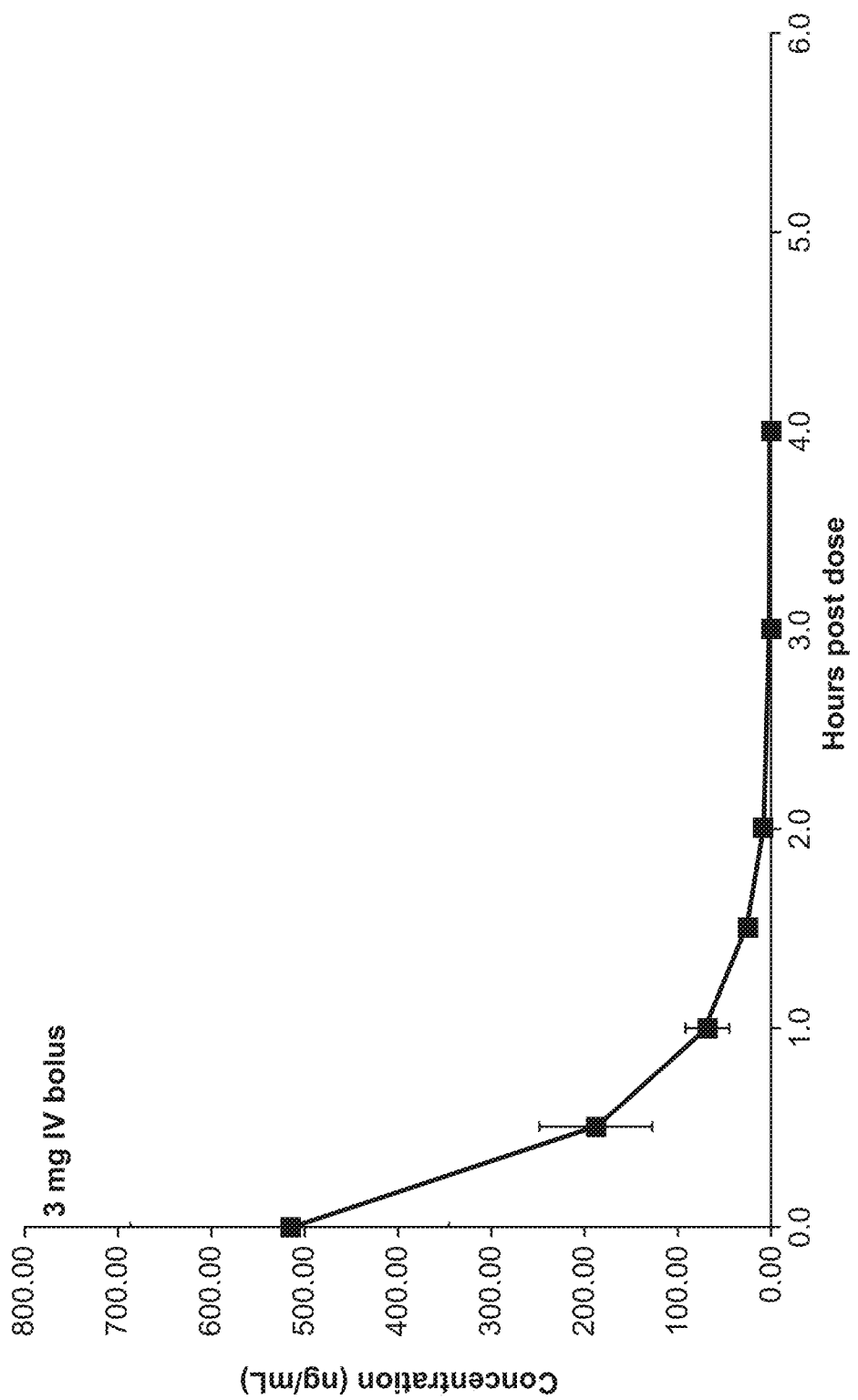
FIG. 27 (Cont. 1)

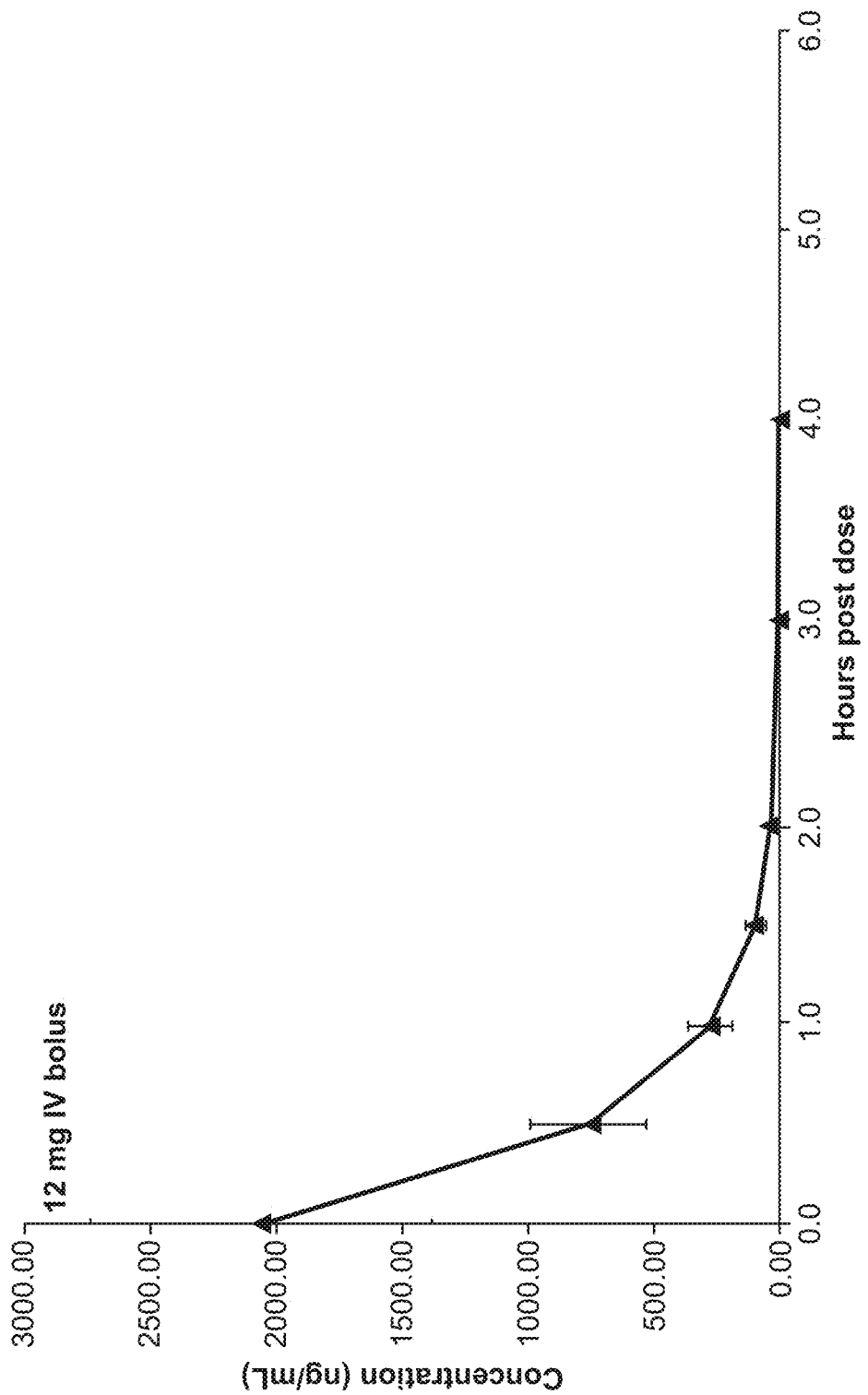
FIG. 27 (Cont. 2)

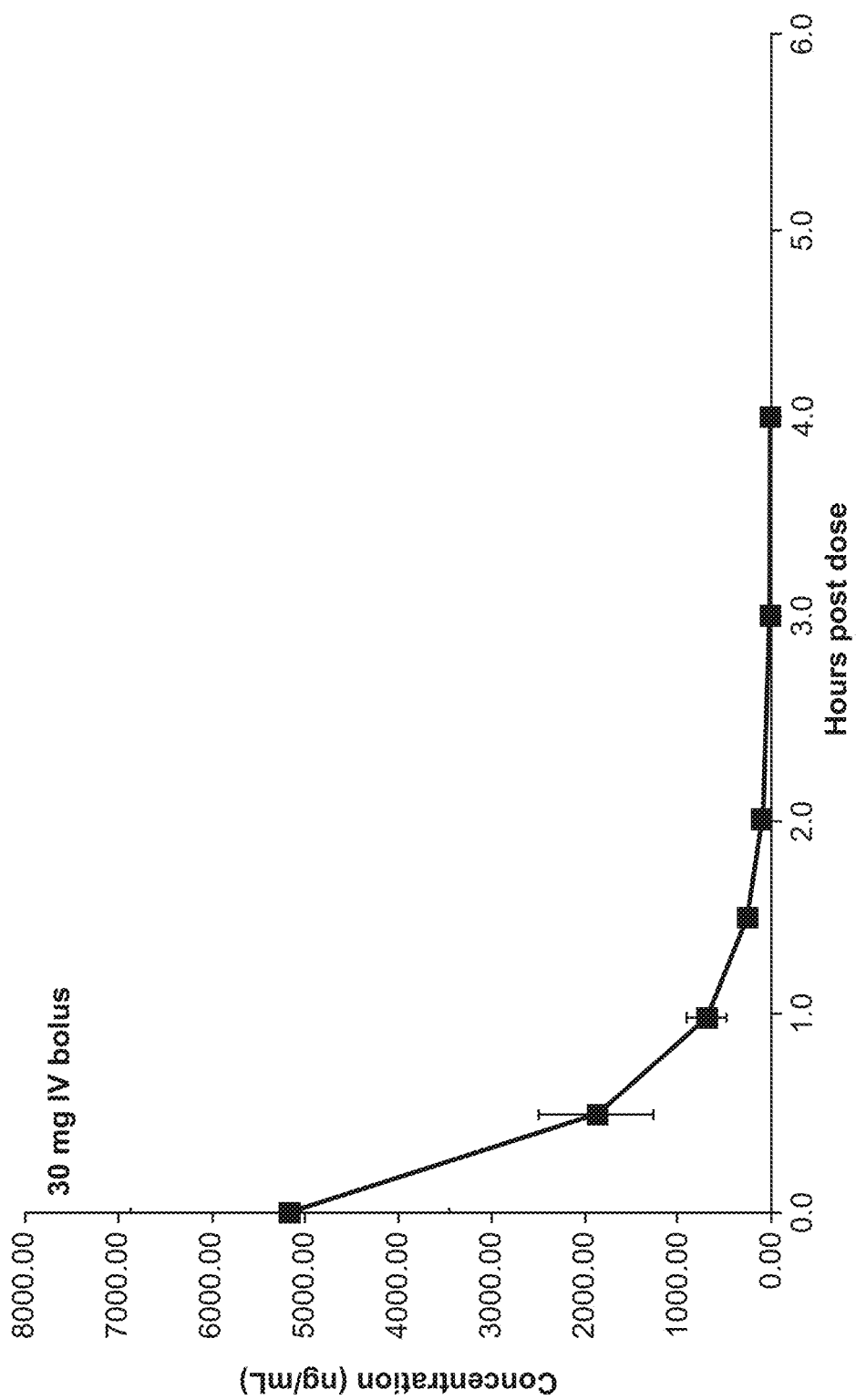
FIG. 27 (Cont. 3)

Construct 1

```
                    *  *  *  *   *    *    * ********  *  **  ***
SEQ ID NO: 1025  VPINVKCRGSRDCLDPCKKAGMRFGKCINSKCHCTP
SEQ ID NO: 800   VRIPVSCKHSGQCLKPCKDAGMRFGKCMNGKCDCTPK
```

FIG. 38A

```
                 *  ****  *    *     *      *   *****  ** *
SEQ ID NO: 1025  VPINVKCRGSRDCLDPCKKA-GMRFGKCINSKCHCTP
SEQ ID NO: 1026  VQTNVKCQGG-SCASVCRREIGVAAGKCINGKCVCYRN
```

FIG. 38B

```
                  * ********    **   **  *  *    *** * ** * *
SEQ ID NO: 1025  VPINVKCRGSRDCLDPCKKA-GMRFGKCINSKCHCTP
SEQ ID NO: 967   VFINVKCRGSPECLPKCKEAIGKSAGKCMNGKCKCYP
```

FIG. 38C

```
                  *    *  **  *      *        *      **  *****  ****  **
SEQ ID NO: 804    QVQTNVKCQGGS-CASVCRREIGVAAGKCINGKCVCYRN
SEQ ID NO: 968    VFINAKCRGSPECLPKCKEAIGKAAGKCMNGKCKCYP
                                                 └─────────────┘
                                                  Predicted Dyad
```

FIG. 39

```
                              10         20         30
                     ....*....|....*....|....*....|....
SEQ ID NO:978    5   IKCSESYQCFPVCKSRFGKTNG-RCVNGFCDCF  36
SEQ ID NO:979    5   VKCSSPQQCLKPCKAAFGISAGgKCINGKCKCY  37
SEQ ID NO:980   26   VSCSASSQCWPVCKKLFGTYRG-KCMNSKCRCY  57
SEQ ID NO:981    5   ESCTASNQCWSICKRLHNTNRG-KCMNKKCRCY  36
SEQ ID NO:982    5   VSCTTSKECWSVCEKLYNTSRG-KCMNKKCRCY  36
SEQ ID NO:983    4   MRCKSSKECLVKCKQATGRPNG-KCMNRKCKCY  35
SEQ ID NO:984    1   IKCTLSKDCYSPCKKETGCPRA-KCINRNCKCY  32
SEQ ID NO:985    1   IRCSGSRDCYSPCMKQTGCPNA-KCINKSCKCY  32
SEQ ID NO:986   27   IRCSGTRECYAPCQKLTGCLNA-KCMNACKCY  58
SEQ ID NO:987    2   ISCTNPKQCYPHCKKETGYPNA-KCMNRKCKCF  33
SEQ ID NO:988    1   ASCRTPKDCADPCRKETGCPYG-KCMNRKCKCN  32
SEQ ID NO:989    3   TSCISPKQCTEPCRAK-GCKHG-KCMNRKCHCM  33
SEQ ID NO:990    2   KECTGPQHCTNFCRKN-KCTHG-KCMNRKCKCF  32
SEQ ID NO:991   27   IKCRTPKDCADPCRKQTGCPHA-KCMNKTCRCH  58
SEQ ID NO:992    5   VKCTTSKECWPPCKAATGKAAG-KCMNKKCKCQ  36
SEQ ID NO:993    8   LECGASRECYDPCKAFGRAHG-KCMNNKCRCY  39
SEQ ID NO:994    5   EKCFATSQCWTPCKKAIGSLQS-KCMNGKCKCY  36
SEQ ID NO:995   27   VRCYASRECWEPCRRVTGSAQA-KCQNNQCRCY  58
SEQ ID NO:996   28   VKCSASRECWVACKKVTGSGQG-KCQNNQCRCY  59
SEQ ID NO:997    5   VKCISSQECWIACKKVTGRFEG-KCQNRQCRCY  36
SEQ ID NO:998    5   VRCYDSRQCWIACKKVTGSTQG-KCQNKQCRCY  36
SEQ ID NO:999    5   VDCTVSKECWAPCKAAFGVDRG-KCMGKKCKCY  36
SEQ ID NO:1000   5   AKCRGSPECLPKCKEAIGKAAG-KCMNGKCKCY  36
SEQ ID NO:1001  28   KKCQGGS-CASVCRRVIGVAAG-KCINGRCVCY  58
SEQ ID NO:1002  28   KKCSNTSQCYKTCEKVVGVAAG-KCMNGKCICY  59
SEQ ID NO:1003   6   VKCSGSSKCVKICIDRYNTRGA-KCINGRCTCY  37
SEQ ID NO:1004  28   NRCNNSSECIPHCIRIFGTRAA-KCINRKCYCY  59
SEQ ID NO:1005  28   KECNGSSECYSHCEGITGKRSG-KCINKKCYCY  59
SEQ ID NO:1006   1   AFCNL-RRCELSCRSL--GLLG-KCIGEECKCV  29
SEQ ID NO:1007  29   AVCNL-KRCQLSCRSL--GLLG-KCIGDKCECV  57
SEQ ID NO:1008   1   AACYSS-DCRVKCVAM-GFSSG-KCINSKCKCY  30
SEQ ID NO:1009  27   AICATDADCSRKCP---GNPP---CRNGFCACT  53
SEQ ID NO:1010  28   TECQIKNDCQRYCQSVK------ECKYGKCYCN  54
SEQ ID NO:1011   2   TQCQSVRDCQQYCLTPD------RCSYGTCYCK  28
SEQ ID NO:1012  29   VSCRYGSDCAEPCKRLKCLLPS-KCINGKCTCY  60
SEQ ID NO:1013  28   IKCRYPADCHIMCKVTGRAEG-KCMNGKCTCY  59
SEQ ID NO:1014  28   IKCSSSSCYEPCRGVTGRAHG-KCMNGRCTCY  59
SEQ ID NO:1015   5   VKCTGSKQCLPACKAAVGKAAG-KCMNGKCKCY  36
SEQ ID NO:1016   5   VSCKHSGQCIKPCKDA-GMRFG-KCMNRKCDCT  35
SEQ ID NO:1017   6   VKCRGSPQCIQPCRDA-GMRFG-KCMNGKCHCT  36
SEQ ID NO:1018   5   VKCTSPKQCLPPCKAQFGIRAgKCMNGKCKCY  37
SEQ ID NO:1019   5   VKCTSPKQCSKPCKELYGSSAgKCMNGKCKCY  37
SEQ ID NO:1020   5   VKCTSPKQCLPPCKEIYGRHAgKCMNGKCHCS  37
SEQ ID NO:1021  25   VKCTGSKQCWPVCKQMFGKPNG-KCMNGKCRCY  56
SEQ ID NO:1022  28   VKCRGSRDCLDPCKKA-GMRFG-KCINSKCHCT  58
SEQ ID NO:1023  28   VRCVTDDDCFRKCP---GNPS---CKRGFCACK  54
SEQ ID NO:1024  28   VPCNNSRPCVPVCIREVNNKNG-KCSNGKCLCY  59
```

FIG. 40

SEQ ID NO: 978 --------IKCSESYQCFPVCKSRFGKTNGRCVNGFCDCF-
SEQ ID NO: 511 GSGVPINVKCRGSRDCLDPCK-KAGMRFGKCINSKCHCTP
               :**   * :*: ** : *   *:*:*. *.*

FIG. 41

SEQ ID NO:

```
                        10           20           30
 805   ...EVTRCSGSKQCYGPCKQQTGCTNSKCMNKVCKCYGCG
1027   ..AEILRCSGTRECYAPCQKLTGCLNAKCMNKACKCYGCV
1028   .RPTDLKCSASYQCFPVCKSRFGKTNGRCVNGLCDCF...
1029   .QFTDVKCTGSKQCWPVCKQMFGKPNGKCMNGKCRCYS..
 801   GVPINVKCRGSRDCIDPCKKA.GMRFGKCINSKCHCTP..
 882   GVPINVECRGSRDCIDPCRRA.GMRFGRCINSRCHCTP..
 824   .VGINVKCHSGQCIKPCKDA.GMRFGKCINGKCDCTPK.
1030   .VGINVKCHSRQCIKPCKDA.GMRFGKCTNGKCHCTPK.
 800   .VRIPVSCKHSGQCIKPCKDA.GMRFGKCMNGKCDCTPK.
 817   GVIINVKCKISRQCIEPCKKA.GMRFGKCMNGKCHCTPK.
 821   GVPTDVKCRGSPQCIQPCKDA.GMRFGKCMNGKCHCTPK.
 970   .VPTDVKCRGSPQCIQPCKDA.GMRFGKCMNGKCHCTP.
 822   GVPINVSCTGSPQCIKPCKDA.GMRFGKCMNRKCHCTPK.
 967   .VFINVKCRGSPICIPKCKEAIGKSAGKCMNGKCKCYP..
1031   .VVGQRCYRSPDCYSACKKLVGKATGKCTNGRCDC....
1032   ..NFKVEGACSKPCRKYCIDK.GARNGKCINGRCHCYY..
1033   QIDTNVKCSGSSKCVKICIDRYNTRGAKCINGRCTCYP..
 958   QKILSNRCNNSSECIPHCIRIFGTRAAKCINRKCYCYP..
 780   .v.i.vkc.gs.qCl.pCk.a.g.r.gkCmNgkC.C.p..
```

FIG. 44

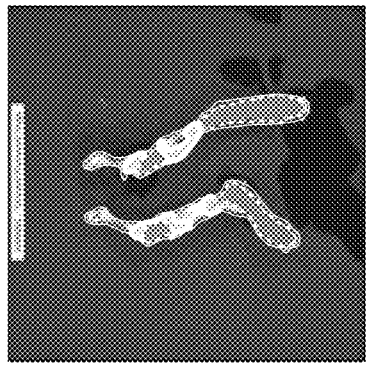
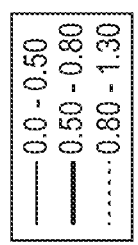
FIG. 46A
3 hours
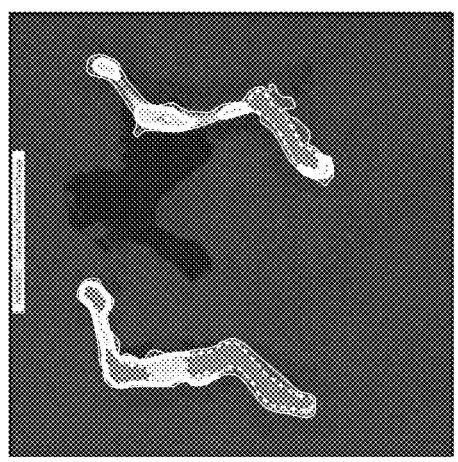
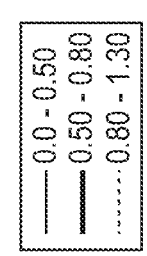
FIG. 46B
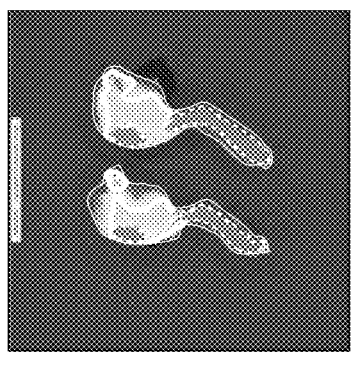
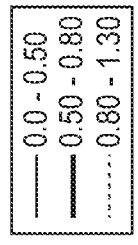
FIG. 46C
24 hours
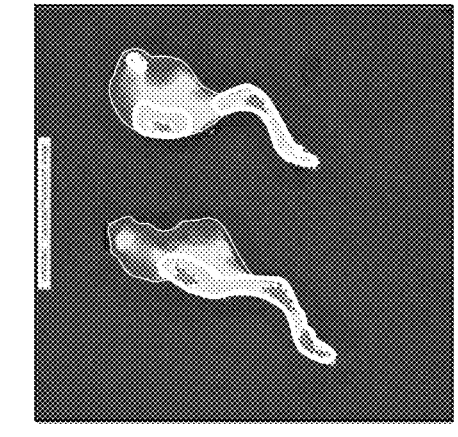
FIG. 46D 48 hours
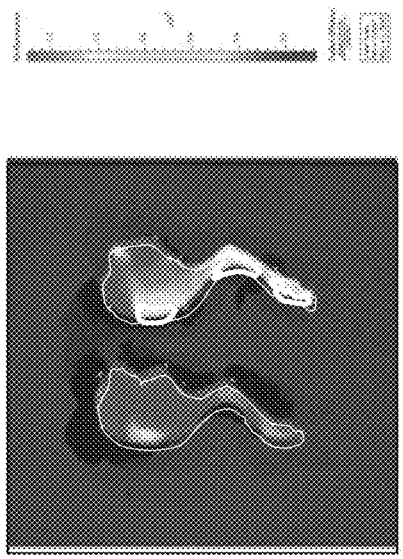
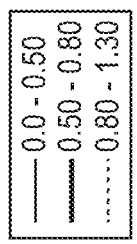
FIG. 46E
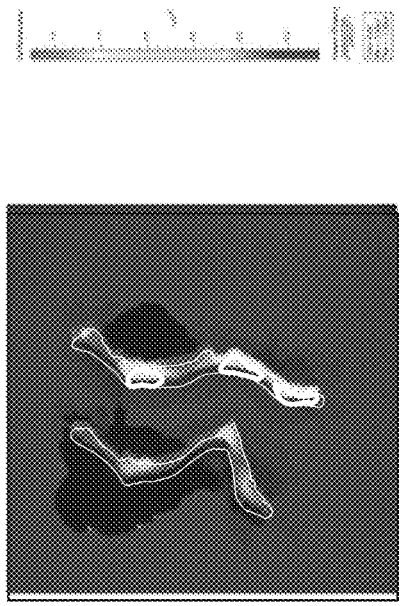
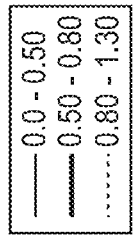
FIG. 46F
72 hours
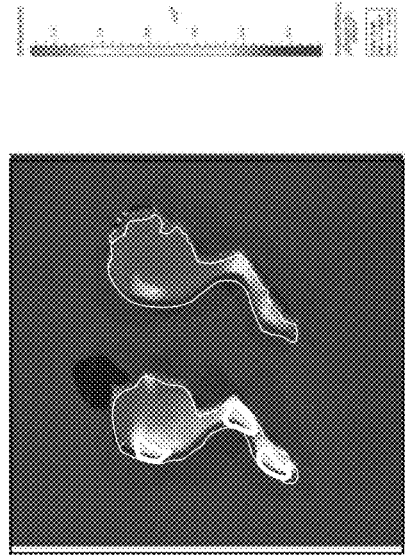
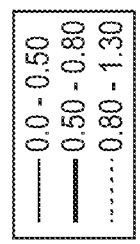
FIG. 46G
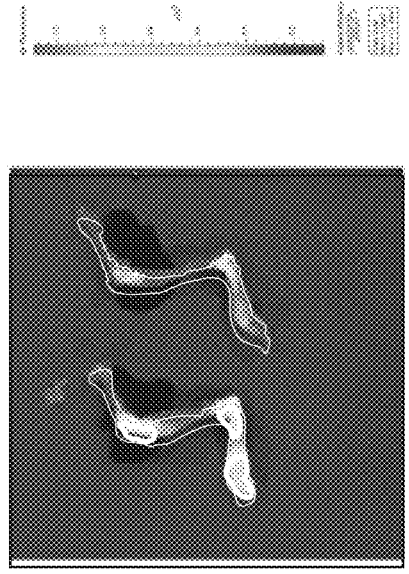
FIG. 46H

TISSUE-HOMING PEPTIDE CONJUGATES AND METHODS OF USE THEREOF

CROSS-REFERENCE

This application is a continuation-in-part of U.S. patent application Ser. No. 17/230,353, filed Apr. 14, 2021, which is a continuation of U.S. patent application Ser. No. 16/492,914, filed Sep. 10, 2019, now U.S. Pat. No. 11,013,814, which is a national stage entry of International Application No. PCT/US2018/023006, filed Mar. 16, 2018, which claims the benefit of U.S. Provisional Patent Application No. 62/472,485, filed Mar. 16, 2017, and U.S. patent application Ser. No. 17/409,661 is a continuation-in-part of U.S. patent application Ser. No. 16/704,955, filed Dec. 5, 2019, which is a divisional of U.S. patent application Ser. No. 14/855,355, filed Sep. 15, 2015, now abandoned, which is a continuation of International Application No. PCT/US2014/056177, filed Sep. 17, 2014, which claims the benefit of U.S. Provisional Patent Application No. 61/990,101, filed May 7, 2014, U.S. Provisional Patent Application No. 61/879,108, filed Sep. 17, 2013, and U.S. Provisional Patent Application No. 61/879,096, filed Sep. 17, 2013, which are incorporated herein by reference in their entirety for all purposes.

STATEMENT AS TO FEDERALLY SPONSORED RESEARCH

This invention was made with the support of the United States government by the National Cancer Institute, National Institutes of Health, Department of Health and Human Services, under Contract No. HHSN261201200054C.

SEQUENCE LISTING

The instant application contains a Sequence Listing which has been submitted electronically in ASCII format and is hereby incorporated by reference in its entirety. Said ASCII copy, created on Jul. 22, 2021, is named "109561-691093_SL.txt" and is 547,229 bytes in size.

BACKGROUND OF THE INVENTION

Cartilage comprises chondrocytes, a specialized cell-type which produces components of the extracellular matrix, mainly including collagen, proteoglycans (e.g., aggrecan), and elastic fibers. The extracellular matrix proteins provide support, cushion, and durability to cartilage-rich portions of the body such as joints, ears, nose, and windpipe. Cartilage is one of few tissues in the body which does not contain blood vessels and is considered an avascular tissue. Unlike many cells in the body which rely on a combination of blood flow and diffusion, chondrocytes rely on diffusion. Because it does not have a direct blood supply, compared to other connective tissues, cartilage grows and repairs much more slowly. As a result, cartilage disorders are particularly difficult to treat.

Furthermore, for many types of cancer, the precision of surgical resection directly influences patient prognosis. Unfortunately, intra-operative identification of tumor margins or small foci of cancer cells remains imprecise or depends on surgical judgment. Thus, the extent of surgical resection is constrained by the requirement to avoid harming vital structures.

Despite the advances in the development of probes for targeting and imaging tumors, there exists a need for a probe that allows for intra-operative visualization of cancerous tissues.

SUMMARY OF THE INVENTION

The present disclosure relates to compositions and methods for treatment of cartilage disorders. Described herein are peptides that home to, migrate to, accumulate in, bind to, are retained by, or are directed to, and/or bind in cartilage following administration in a subject. In some embodiments, the homing peptides of the present disclosure are used to deliver a detection agent to image and/or diagnose cartilage, injury, or disease. In some embodiments, compositions and methods for treatment of kidney disorders are described. In other embodiments, the homing peptides of the present disclosure are used to treat or deliver an active agent to a region, tissue, structure, or cell thereof.

In some aspects, a peptide active agent conjugate comprises: a) a peptide, wherein the peptide comprises a sequence that has at least 70% sequence identity with any one of SEQ ID NO: 508-SEQ ID NO: 758 and upon administration to a subject the peptide homes, targets, migrates to, accumulates in, binds to, is retained by, or is directed to a cartilage of the subject, and an active agent selected from an active agent class selected from TABLE 53 or TABLE 55; b) a peptide, wherein the peptide comprises a sequence that has at least 70% sequence identity with any one of SEQ ID NO: 508-SEQ ID NO: 758 and upon administration to a subject the peptide homes, targets, migrates to, accumulates in, binds to, is retained by, or is directed to a kidney of the subject, and an active agent selected from an active agent class selected from TABLE 54 or TABLE 55; c) a peptide, wherein the peptide comprises a sequence that has at least 70% sequence identity with any one of SEQ ID NO: 508-SEQ ID NO: 758 and upon administration to a subject the peptide homes, targets, migrates to, accumulates in, binds to, is retained by, or is directed to a cartilage or kidney of the subject, and an active agent selected from TABLE 53, TABLE 54, or TABLE 55; d) a peptide, wherein the peptide comprises a sequence that has at least 70% sequence identity with any one of SEQ ID NO: 798-SEQ ID NO: 1048 and upon administration to a subject the peptide homes, targets, migrates to, accumulates in, binds to, is retained by, or is directed to a cartilage of the subject, and an active agent selected from TABLE 53 or TABLE 55; e) a peptide, wherein the peptide comprises a sequence that has at least 70% sequence identity with any one of SEQ ID NO: 798-SEQ ID NO: 1048 and upon administration to a subject the peptide homes, targets, migrates to, accumulates in, binds to, is retained by, or is directed to a kidney of the subject, and an active agent selected from an active agent class selected from TABLE 54 or TABLE 55; f) a peptide, wherein the peptide comprises a sequence that has at least 70% sequence identity with any one of SEQ ID NO: 798-SEQ ID NO: 1048 and upon administration to a subject the peptide homes, targets, migrates to, accumulates in, binds to, is retained by, or is directed to a cartilage or kidney of the subject, and an active agent selected from an active agent class selected from TABLE 53, TABLE 54, or TABLE 55; g) a peptide, wherein the peptide comprises a sequence that has at least 70% sequence identity with any one of SEQ ID NO: 744-SEQ ID NO: 758 and upon administration to a subject the peptide homes, targets, migrates to, accumulates in, binds to, is retained by, or is directed to a cartilage of the subject, and an active agent selected from TABLE 53, TABLE 55, or TABLE 56; h) a peptide, wherein the peptide comprises a sequence that has at least 70% sequence identity with any one of SEQ ID NO: 744-SEQ ID NO: 758 and upon administration to a subject the peptide homes, targets, migrates to, accumulates in, binds to, is retained by, or is directed to a kidney of the subject, and an active agent selected from TABLE 54, TABLE 55, or TABLE 56; i) a peptide, wherein the peptide comprises a sequence that has at least 70% sequence identity with any one of SEQ ID NO: 744-SEQ ID NO: 758 and upon administration to a subject the peptide homes, targets, migrates to, accumulates in, binds to, is retained by, or is directed to a cartilage or a kidney of the subject, and an active agent selected from TABLE 53, TABLE 54, TABLE 55, or TABLE 56; j) a peptide, wherein the peptide comprises a sequence that has at least 70% sequence identity with any one of SEQ ID NO: 1034-SEQ ID NO: 1048 and upon administration to a subject the peptide homes, targets, migrates to, accumulates in, binds to, is retained by, or is directed to a cartilage of the subject, and an active agent selected from TABLE 53, TABLE 55, or TABLE 56; k) a peptide, wherein the peptide comprises a sequence that has at least 70% sequence identity with any one of SEQ ID NO: 1034-SEQ ID NO: 1048 and upon administration to a subject the peptide homes, targets, migrates to, accumulates in, binds to, is retained by, or is directed to a kidney of the subject, and an active agent selected from TABLE 54, TABLE 55, or TABLE 56; or l) a peptide, wherein the peptide comprises a sequence that has at least 70% sequence identity with any one of SEQ ID NO: 1034-SEQ ID NO: 1048 and upon administration to a subject the peptide homes, targets, migrates to, accumulates in, binds to, is retained by, or is directed to a cartilage or a kidney of the subject, and an active agent selected from TABLE 53, TABLE 54, TABLE 55, or TABLE 56. In some embodiments, the peptide comprises: a) a sequence that has at least 75%, at least 80%, at least 85%, at least 90%, at least 95%, at least 97%, at least 99% or 100% sequence identity with any one of SEQ ID NO: 508-SEQ ID NO: 758 or a fragment thereof; b) a sequence that has at least 75%, at least 80%, at least 85%, at least 90%, at least 95%, at least 97%, at least 99% or 100% sequence identity with any one of SEQ ID NO: 744-SEQ ID NO: 758 or a fragment thereof; c) a sequence that has at least 75%, at least 80%, at least 85%, at least 90%, at least 95%, at least 97%, at least 99% or 100% sequence identity with any one of SEQ ID NO: 798-SEQ ID NO: 1048 or a fragment thereof; or d) a sequence that has at least 75%, at least 80%, at least 85%, at least 90%, at least 95%, at least 97%, at least 99% or 100% sequence identity with any one of SEQ ID NO: 1034-SEQ ID NO: 1048 or a fragment thereof. In some embodiments, the peptide comprises: a) a sequence of any one of SEQ ID NO: 508-SEQ ID NO: 758 or a fragment thereof; b) a sequence of any one of SEQ ID NO: 744-SEQ ID NO: 758 or a fragment thereof; c) a sequence of any one of SEQ ID NO: 798-SEQ ID NO: 1048 or a fragment thereof; or d) a sequence of any one of SEQ ID NO: 1034-SEQ ID NO: 1048 or a fragment thereof.

In some aspects, a peptide comprises a sequence that has at least 70%, at least 75%, at least 80%, at least 85%, at least 90%, at least 95%, at least 97%, at least 99%, or 100% sequence identity with any one of SEQ ID NO: 744-SEQ ID NO: 758 or at least 70%, at least 75%, at least 80%, at least 85%, at least 90%, at least 95%, at least 97%, at least 99%, or 100% sequence identity with any one of SEQ ID NO: 1034-SEQ ID NO: 1048.

In some embodiments, the peptide comprises: a) a sequence of any one of SEQ ID NO: 485-SEQ ID NO: 507 or a fragment thereof; b) a sequence of any one of SEQ ID NO: 759-SEQ ID NO: 781 or a fragment thereof; c) a sequence of any one of SEQ ID NO: 50-SEQ ID NO: 507 or a fragment thereof; or d) a sequence of any one of SEQ ID NO: 779-SEQ ID NO: 781 or a fragment thereof. In some embodiments, the peptide is at least 30%, at least 40%, at least 50%, at least 60%, at least 70%, at least 80%, at least 90%, at least 95%, at least, 97%, at least 98%, or at least 99% identical to any one of SEQ ID NO: 978-SEQ ID NO: 1024 or at least 30%, at least 40%, at least 50%, at least 60%, at least 70%, at least 80%, at least 90%, at least 95%, at least 97%, at least 98%, or at least 99% identical to any one of SEQ ID NO: 688-SEQ ID NO: 734. In some embodiments, the peptide is at least 70%, at least 80%, at least 90%, at least 95%, at least 97%, or 100% identical to: a) SEQ ID NO: 595; b) SEQ ID NO: 885; c) SEQ ID NO: 508 SEQ ID NO: 508; d) SEQ ID NO: 798; e) SEQ ID NO: 511; f) SEQ ID NO: 801; g) SEQ ID NO: 669; h) SEQ ID NO: 959; i) SEQ ID NO: 514; j) SEQ ID NO: 804; k) SEQ ID NO: 592; l) SEQ ID NO: 882; m) SEQ ID NO: 520; n) SEQ ID NO: 810; o) SEQ ID NO: 683; p) SEQ ID NO: 962; q) SEQ ID NO: 509; r) SEQ ID NO: 799; s) SEQ ID NO: 590; t) SEQ ID NO: 880; u) SEQ ID NO: 510; v) SEQ ID NO: 800; w) SEQ ID NO: 671; x) SEQ ID NO: 961; y) SEQ ID NO: 591; or z) SEQ ID NO: 881. In some embodiments, the peptide is at least 70%, at least 80%, at least 90%, at least 95%, at least 97%, at least 99%, or 100% identical to: a) SEQ ID NO: 1034; b) SEQ ID NO: 1035; c) SEQ ID NO: 1036; d) SEQ ID NO: 1037; e) SEQ ID NO: 1038; f) SEQ ID NO: 1039; g) SEQ ID NO: 1040; h) SEQ ID NO: 1041; i) SEQ ID NO: 1042; j) SEQ ID NO: 1043; k) SEQ ID NO: 1044; l) SEQ ID NO: 1045; m) SEQ ID NO: 1046; n) SEQ ID NO: 1047; o) SEQ ID NO: 1048; p) SEQ ID NO: 744; q) SEQ ID NO: 745; r) SEQ ID NO: 746; s) SEQ ID NO: 747; t) SEQ ID NO: 748; u) SEQ ID NO: 749; v) SEQ ID NO: 750; w) SEQ ID NO: 751; x) SEQ ID NO: 752; y) SEQ ID NO: 753; z) SEQ ID NO: 754; aa) SEQ ID NO: 755; bb) SEQ ID NO: 756; cc) SEQ ID NO: 757; or dd) SEQ ID NO: 758. In some embodiments, the peptide homes, targets, migrates to, accumulates in, binds to, is retained by, or is directed to cartilage, to kidney, or to cartilage and kidney. In some embodiments, the peptide homes, targets, migrates to, accumulates in, binds to, is retained by, or is directed to proximal tubules of the kidney. In some embodiments, the peptide is covalently conjugated to the active agent. In some embodiments, the peptide active agent conjugate homes, targets, migrates to, accumulates in, binds to, is retained by, or is directed to a cartilage or a kidney of the subject.

In some embodiments, the peptide comprises 4 or more cysteine residues. In some embodiments, the peptide comprises three or more disulfide bridges formed between cysteine residues, wherein one of the disulfide bridges passes through a loop formed by two other disulfide bridges. In some embodiments, the peptide comprises a plurality of disulfide bridges formed between cysteine residues. In some embodiments, the peptide comprises a disulfide through a disulfide knot. In some embodiments, at least one amino acid residue of the peptide is in an L configuration or, wherein at least one amino acid residue of the peptide is in a D configuration.

In some embodiments, the sequence comprises at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58 residues, at least 59, at least 60, at least 61, at least 62, at least 63, at least 64, at least 65, at least 66, at least 67, at least 68, at least 69, at least 70, at least 71, at least 72, at least 73, at least 74, at least 75, at least 76, at least 77, at least 78, at least 79, at least 80, or at least 81 residues.

In some embodiments, any one or more K residues are replaced by an R residue or wherein any one or more R residues are replaced by a K residue. In some embodiments, any one or more M residues are replaced by any one of the I, L, or V residues. In some embodiments, any one or more L residues are replaced by any one of the V, I, or M residues. In some embodiments, any one or more I residues are replaced by any of the M, L, or V residues. In some embodiments, any one or more V residues are replaced by any of the M, I, or L residues. In some embodiments, any one or more G residues are replaced by an A residue or wherein any one or more A residues are replaced by a G residue. In some embodiments, any one or more S residues are replaced by a T residue or wherein any one or more T residues are replaced by for an S residue. In some embodiments, any one or more Q residues are replaced by an N residue or wherein any one or more N residues are replaced by a Q residue. In some embodiments, any one or more D residues are replaced by an E residue or wherein any one or more E residues are replaced by a D residue.

In some embodiments, the peptide has a charge distribution comprising an acidic region and a basic region. In some embodiments, the acidic region is a nub. In some embodiments, the basic region is a patch. In some embodiments, the peptide comprises 5-12 basic residues. In some embodiments, the peptide comprises 0-5 acidic residues. In some embodiments, the peptide comprises 6 or more basic residues and 2 or fewer acidic residues. In some embodiments, the peptide comprises a 4-19 amino acid residue fragment containing at least 2 cysteine residues, and at least 2 positively charged amino acid residues. In some embodiments, the peptide comprises a 20-70 amino acid residue fragment containing at least 2 cysteine residues, no more than 2 basic residues and at least 2 positively charged amino acid residues. In some embodiments, the peptide comprises at least 3 positively charged amino acid residues. In some embodiments, the positively charged amino acid residues are selected from K, R, or a combination thereof.

In some embodiments, the peptide has a charge greater than 2 at physiological pH. In some embodiments, the peptide has a charge greater than 3.5 at physiological pH. In some embodiments, the peptide has a charge greater than 4.5 at physiological pH. In some embodiments, the peptide has a charge greater than 5.5 at physiological pH. In some embodiments, the peptide has a charge greater than 6.5 at physiological pH. In some embodiments, the peptide has a charge greater than 7.5 at physiological pH. In some embodiments, the peptide has a charge greater than 8.5 at physiological pH. In some embodiments, the peptide has a charge greater than 9.5 at physiological pH.

In some embodiments, the peptide is selected from a potassium channel agonist, a potassium channel antagonist, a portion of a potassium channel, a sodium channel agonist, a sodium channel antagonist, a calcium channel agonist, a calcium channel antagonist, a hadrucalcin, a theraphotoxin, a huwentoxin, a kaliotoxin, a cobatoxin, or a lectin. In some embodiments, the lectin is SHL-Ib2.

In some embodiments, the peptide is arranged in a multimeric structure with at least one other peptide.

In some embodiments, at least one residue of the peptide comprises a chemical modification. In some embodiments, the chemical modification is blocking the N-terminus of the peptide. In some embodiments, wherein the chemical modification is methylation, acetylation, or acylation. In some embodiments, the chemical modification is: methylation of one or more lysine residues or analogue thereof; methylation of the N-terminus; or methylation of one or more lysine residue or analogue thereof and methylation of the N-terminus. In some embodiments, the peptide is linked to an acyl adduct.

In some embodiments, the peptide is linked to an active agent. In some embodiments, the active agent is fused with the peptide at an N-terminus or a C-terminus of the peptide. In some embodiments, the active agent is another peptide. In some embodiments, the active agent is an antibody. In some embodiments, the active agent is an Fc domain, Fab domain, scFv, or Fv fragment. In some embodiments, the peptide fused with an Fc domain comprises a contiguous sequence. In some embodiments, 1, 2, 3, 4, 5, 6, 7, 8, 9, or 10 active agents are linked to the peptide. In some embodiments, the peptide is linked to the active agent at an N-terminus, at the epsilon amine of an internal lysine residue, at the carboxylic acid of an aspartic acid or glutamic acid residue, or a C-terminus of the peptide by a linker. In some embodiments, the peptide is linked to the active agent via a cleavable linker. In some embodiments, the peptide or peptide active agent conjugate further comprises a non-natural amino acid, wherein the non-natural amino acid is an insertion, appendage, or substitution for another amino acid.

In some embodiments, the peptide is linked to the active agent at the non-natural amino acid by a linker. In some embodiments, the linker comprises an amide bond, an ester bond, a carbamate bond, a carbonate bond, a hydrazone bond, an oxime bond, a disulfide bond, a thioester bond, a thioether bond, a triazole, a carbon-carbon bond, or a carbon-nitrogen bond. In some embodiments, the cleavable linker comprises a cleavage site for matrix metalloproteinases, thrombin, cathepsins, or beta-glucuronidase. In some embodiments, the linker is a hydrolytically labile linker. In some embodiments, the linker is pH sensitive, reducible, glutathione-sensitive, or protease cleavable. In some embodiments, the peptide is linked to the active agent via a stable linker. In some embodiments, the peptide has an isoelectric point of about 9.

In some embodiments, the peptide is linked to a detectable agent. In some embodiments, the detectable agent is fused with the peptide at an N-terminus or a C-terminus of the peptide. In some embodiments, 1, 2, 3, 4, 5, 6, 7, 8, 9, or 10 detectable agents are linked to the peptide. In some embodiments, the peptide is linked to the detectable agent via a cleavable linker. In some embodiments, the peptide is linked to the detectable agent at an N-terminus, at the epsilon amine of an internal lysine residue, or a C-terminus of the peptide by a linker. In some embodiments, the peptide active agent conjugate or peptide further comprises a non-natural amino acid, wherein the non-natural amino acid is an insertion, appendage, or substitution for another amino acid.

In some embodiments, the peptide is linked to the detectable agent at the non-natural amino acid by a linker In some embodiments, the linker comprises an amide bond, an ester bond, a carbamate bond, a hydrazone bond, an oxime bond, or a carbon-nitrogen bond. In some embodiments, the cleavable linker comprises a cleavage site for matrix metalloproteinases, thrombin, cathepsins, or beta-glucuronidase. In some embodiments, the peptide is linked to the detectable agent via a stable linker. In some embodiments, the detectable agent is a fluorophore, a near-infrared dye, a contrast agent, a nanoparticle, a metal-containing nanoparticle, a metal chelate, an X-ray contrast agent, a PET agent, a radioisotope, or a radionuclide chelator. In some embodiments, the detectable agent is a fluorescent dye.

In some aspects, a pharmaceutical composition comprises the peptide active agent conjugate of any embodiment as described herein or a salt thereof, or the peptide of any embodiment as described herein or a salt thereof, and a pharmaceutically acceptable carrier. In some embodiments, the pharmaceutical composition is formulated for administration to a subject. In some embodiments, the pharmaceutical composition is formulated for inhalation, intranasal administration, oral administration, topical administration, parenteral administration, intravenous administration, subcutaneous administration, intra-articular administration, intramuscular administration, intraperitoneal administration, dermal administration, transdermal administration, or a combination thereof.

In some aspects, a method of treating a condition in a subject in need thereof comprises administering to the subject the peptide active agent conjugate of any of embodiment as described herein, the peptide of any of any embodiment as described herein, or a pharmaceutical composition of any embodiment as described herein. In some embodiments, the peptide active agent conjugate, peptide, or pharmaceutical composition is administered by inhalation, intranasally, orally, topically, parenterally, intravenously, subcutaneously, intra-articularly, intramuscularly administration, intraperitoneally, dermally, transdermally, or a combination thereof. In some embodiments, the peptide active agent conjugate or the peptide homes, targets, or migrates to cartilage of the subject following administration. In some embodiments, the condition is associated with cartilage. In some embodiments, the condition is associated with a joint. In some embodiments, the condition is an inflammation, a cancer, a degradation, a growth disturbance, genetic, a tear, an infection, a disease, or an injury. In some embodiments, the condition is a chondrodystrophy. In some embodiments, the condition is a traumatic rupture or detachment. In some embodiments, the condition is a costochondritis. In some embodiments, the condition is a herniation. In some embodiments, the condition is a polychondritis. In some embodiments, the condition is a chordoma. In some embodiments, the condition is a type of arthritis. In some embodiments, the type of arthritis is rheumatoid arthritis. In some embodiments, the type of arthritis is osteoarthritis. In some embodiments, the condition is achondroplasia. In some embodiments, the condition is benign chondroma or malignant chondrosarcoma. In some embodiments, the condition is bursitis, tendinitis, gout, pseudogout, an arthropathy, psoriatic arthritis, ankylosing spondylitis, or an infection. In some embodiments, the peptide active agent conjugate, peptide, or pharmaceutical composition is administered to treat the injury, to repair a tissue damaged by the injury, or to treat a pain caused by the injury. In some embodiments, the peptide active agent conjugate, peptide, or pharmaceutical composition is administered to treat the tear or to repair a tissue damaged by the tear. In some embodiments, the peptide active agent conjugate, peptide, or pharmaceutical composition homes, targets, or migrates to a kidney of the subject following administration. In some embodiments, the condition is associated with a kidney. In some embodiments, the condition is lupus nephritis, acute kidney injury (AKI), chronic kidney disease (CKD), hypertensive kidney damage, diabetic nephropathy, or renal fibrosis.

In some aspects, a method of imaging an organ or body region of a subject comprises: administering to the subject the peptide active agent conjugate of any embodiment as described herein, the peptide of any embodiment as described herein, or the pharmaceutical composition of any embodiment as described herein; and imaging the subject. In some embodiments, the method further comprises detecting a cancer or diseased region, tissue, structure, or cell. In some embodiments, the method further comprises performing surgery on the subject. In some embodiments, the method further comprises treating the cancer. In some embodiments, the surgery comprises removing the cancer or the diseased region, tissue, structure, or cell of the subject. In some embodiments, the method further comprises imaging the cancer or diseased region, tissue, structure, or cell of the subject after surgical removal. In some embodiments, the peptide active agent conjugate is expressed as a fusion protein.

In various aspects, compounds of the present disclosure have the structure of Formula (I), or a pharmaceutically acceptable salt thereof:

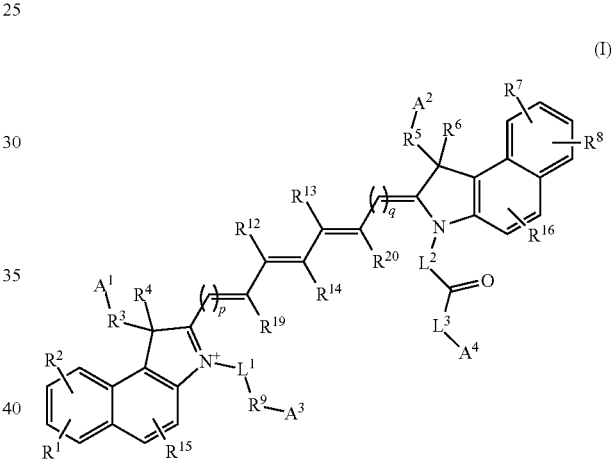

(I)

wherein:
$R^1$, $R^2$, $R^3$, $R^4$, $R^5$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —SO$_2$—NH$_2$, $C_1$-$C_6$ alkoxy, $C_1$-$C_{10}$ alkylene-(C(=O))$_x$—, $C_1$-$C_{10}$ alkylene-(C(=O))$_x$—O—, or $C_1$-$C_{10}$ alkylene-(C(=O))$_x$—NR$^{10}$—;

$R^9$ is hydrogen, sulfonate, —COOH, $C_1$-$C_{10}$ alkylene-(C(=O))$_x$—, $C_1$-$C_{10}$ alkylene-(C(=O))$_x$—O—, or $C_1$-$C_{10}$ alkylene-(C(=O))$_x$—NR$^{10}$—;

$L^1$ is $C_3$-$C_6$ alkylene;

$L^2$ is $C_1$-$C_{10}$ alkylene;

$L^3$ is a bond, —O—, —NR$^{10}$—, —NR$^{10}$—$C_1$-$C_6$ alkylene-, —O—NR$^{10}$—, —NR$^{10}$—$C_1$-$C_6$ alkylene-(O—$C_1$-$C_6$ alkylene)$_n$-, —NR$^{10}$-L$^4$-, —NR$^{10}$—$C_1$-$C_6$ alkylene-NR$^{11}$—(C(=O)—$C_1$-$C_6$ alkylene-O—)$_m$—, or —NR$^{10}$—$C_1$-$C_6$ alkylene-NR$^{10}$—$C_1$-$C_6$ alkylene-NR$^{10}$—$C_1$-$C_6$ alkylene-;

$L^4$ is a bond, -heterocyclyl-, or -heterocyclyl-$C_1$-$C_6$ alkylene-;

$R^{10}$ is hydrogen or $C_1$-$C_6$ alkyl;

$R^{11}$ is hydrogen or $C_1$-$C_6$ alkyl;

$R^{12}$ and $R^{13}$ are each independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring;

$R^{14}$ is hydrogen or $C_1$-$C_6$ alkylene, -($L^5$)-aryl, -($L^5$)-aryl-$A^5$, -($L^5$)-heteroaryl, -($L^5$)-heteroaryl-$A^5$, —$NR^{17}R^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;

$L^5$ is a bond, $C_1$-$C_{10}$ alkylene, —O—, or —$NR^{10}$—;

$R^{17}$ and $R^{18}$ are each independently hydrogen or aryl;

$R^{19}$ and $R^{20}$ are each independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;

n is 0, 1, 2, or 3;
m is 0, 1, 2, or 3;
p is 0, 1, 2, or 3;
q is 0, 1, 2, or 3;
x is 0 or 1; and one of $A^1$, $A^2$, $A^3$, $A^4$, or $A^5$ is a polypeptide having at least 85% sequence identity with MCMPCFTTDHQMARRCDDCCGGR-GRGKCYGPQCLCR or a fragment thereof and the others of $A^1$, $A^2$, $A^3$, $A^4$, or $A^5$ are each independently absent, hydrogen, —COOH, or sulfonate.

In various aspects, the presently described compounds further comprise a detectable label, which can be used for the detection of the peptide-label conjugate and the cancerous cells to which they are bound.

In various aspects, compounds of the present disclosure have the structure of Formula (XV), or a pharmaceutically acceptable salt thereof:

(XV)

wherein:

$R^3$, $R^4$, $R^5$, $R^6$, $R^{15}$, and $R^{16}$ are each independently selected from hydrogen, $C_1$-$C_6$ alkyl, $C_1$-$C_6$ alkylene-COOH, sulfonate, —COOH, —$SO_2$—$NH_2$, $C_1$-$C_6$ alkoxy, $C_1$-$C_{10}$ alkylene-(C(=O))$_x$—, $C_1$-$C_{10}$ alkylene-(C(=O))$_x$—O—, or $C_1$-$C_{10}$ alkylene-(C(=O))$_x$—$NR^{10}$—;

$R^9$ is hydrogen, sulfonate, —COOH, $C_1$-$C_{10}$ alkylene-(C(=O))$_x$—, $C_1$-$C_1$ alkylene-(C(=O))$_x$—O—, or $C_1$-$C_{10}$ alkylene-(C(=O))$_x$—$NR^{10}$—;

$L^1$ is $C_3$-$C_6$ alkylene;

$L^2$ is $C_1$-$C_{10}$ alkylene;

$L^3$ is a bond, —O—, —$NR^{10}$—, —$NR^{10}$—$C_1$-$C_6$ alkylene-, —O—$NR^{10}$—, —$NR^{10}$—$C_1$-$C_6$ alkylene-(O—$C_1$-$C_6$ alkylene)$_n$-, —$NR^{10}$-$L^4$-, —$NR^{10}$—$C_1$-$C_6$ alkylene-$NR^{11}$—(C(=O)—$C_1$-$C_6$ alkylene-O—)$_m$—, or —$NR^{10}$—$C_1$-$C_6$ alkylene-$NR^{10}$—$C_1$-$C_6$ alkylene-$NR^{10}$—$C_1$-$C_6$ alkylene-;

$L^4$ is a bond, -heterocyclyl-, or -heterocyclyl-$C_1$-$C_6$ alkylene-;

$R^{10}$ is hydrogen or $C_1$-$C_6$ alkyl;

$R^{11}$ is hydrogen or $C_1$-$C_6$ alkyl;

$R^{12}$ and $R^{13}$ are each independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring;

$R^{14}$ is hydrogen or $C_1$-$C_6$ alkylene, -($L^5$)-aryl, -($L^5$)-aryl-$A^5$, -($L^5$)-heteroaryl, -($L^5$)-heteroaryl-$A^5$, —$NR^{17}R^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;

$L^5$ is a bond, $C_1$-$C_{10}$ alkylene, —O—, or —$NR^{10}$—;

$R^{17}$ and $R^{18}$ are each independently hydrogen or aryl;

$R^{19}$ and $R^{20}$ are each independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;

$R^{21}$ and $R^{22}$ are each independently selected from hydrogen, $C_1$-$C_6$ alkyl, sulfonate, or $R^{21}$ and $R^{22}$ are joined together along with the other atoms to which they are attached to form a 5-membered or 6-membered aryl;

$R^{23}$ and $R^{24}$ are each independently selected from hydrogen, $C_1$-$C_6$ alkyl, sulfonate, or $R^{23}$ and $R^{24}$ are joined together along with the other atoms to which they are attached to form a 5-membered or 6-membered aryl;

n is 0, 1, 2, or 3;
m is 0, 1, 2, or 3;
p is 0, 1, 2, or 3;
q is 0, 1, 2, or 3;
x is 0 or 1; and one of $A^1$, $A^2$, $A^3$, $A^4$, or $A^5$ is a polypeptide having at least 85% sequence identity with MCMPCFTTDHQMARRCDDCCGGR-GRGKCYGPQCLCR or a fragment thereof and the others of $A^1$, $A^2$, $A^3$, $A^4$, or $A^5$ are each independently absent, hydrogen, —COOH, or sulfonate.

In some aspects, the compounds of the present disclosure have a structure of Formula (II), or a pharmaceutically acceptable salt thereof:

(II)

In certain aspects, the present compounds have a structure of Formula (III), or a pharmaceutically acceptable salt thereof:

(III)

wherein:
- $R^1$, $R^2$, $R^3$, $R^4$, $R^5$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —$SO_2$—$NH_2$, or $C_1$-$C_6$ alkoxy;
- $R^9$ is hydrogen, sulfonate, or —COOH;
- $L^1$ is $C_3$-$C_6$ alkylene;
- $L^2$ is $C_1$-$C_{10}$ alkylene;
- $L^3$ is a bond, —O—, —$NR^{10}$—, —$NR^{10}$—$C_1$-$C_6$ alkylene-, —O—$NR^{10}$—, —$NR^{10}$—$C_1$-$C_6$ alkylene-(O—$C_1$-$C_6$ alkylene)$_n$-, —$NR^{10}$-$L^4$-, —$NR^{10}$—$C_1$-$C_6$ alkylene-$NR^{11}$—(C(=O)—$C_1$-$C_6$ alkylene-O—)$_m$—, or —$NR^{10}$—$C_1$-$C_6$ alkylene $NR^{10}$—$C_1$-$C_6$ alkylene $NR^{10}$—$C_1$-$C_6$ alkylene-;
- $L^4$ is a bond, -heterocyclyl-, or -heterocyclyl-$C_1$-$C_6$ alkylene-;
- $R^{10}$ is hydrogen or $C_1$-$C_6$ alkyl;
- $R^{11}$ is hydrogen or $C_1$-$C_6$ alkyl;
- $R^{12}$ and $R^{13}$ are independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring;
- $R^{14}$ is hydrogen or $C_1$-$C_6$ alkylene, -($L^5$)-aryl, -($L^5$)-heteroaryl, —$NR^{17}R^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;
- $L^5$ is a bond, $C_1$-$C_{10}$ alkylene, —O—, —$NR^{10}$—;
- $R^{17}$ and $R^{18}$ are each independently hydrogen or aryl;
- $R^{19}$ and $R^{20}$ are independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;
- n is 0, 1, 2, or 3;
- m is 0, 1, 2, or 3;
- p is 0, 1, 2, or 3;
- q is 0, 1, 2, or 3; and
- $A^4$ is a polypeptide having at least 85% sequence identity with MCMPCFTTDHQMARRCDDCCGGR-GRGKCYGPQCLCR or a fragment thereof.

In other aspects, compounds of the present disclosure have a structure of Formula (IV), or a pharmaceutically acceptable salt thereof:

(IV)

wherein:
- $R^1$, $R^2$, $R^4$, $R^5$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —$SO_2$—$NH_2$, or $C_1$-$C_6$ alkoxy;
- $R^3$ is selected from $C_1$-$C_{10}$ alkylene-(C(=O))$_x$—, $C_1$-$C_{10}$ alkylene-(C(=O))$_x$—O—, or $C_1$-$C_{10}$ alkylene-(C(=O))$_x$—$NR^{10}$—;
- $R^9$ is hydrogen, sulfonate, or —COOH, or $C_1$-$C_{10}$ alkyl;
- $L^1$ is $C_3$-$C_6$ alkylene;
- $L^2$ is $C_1$-$C_{10}$ alkylene;
- $L^3$ is hydrogen, sulfonate, —COOH, $C_1$-$C_{10}$ alkyl;
- $L^4$ is a bond, -heterocyclyl-, or -heterocyclyl-$C_1$-$C_6$ alkylene-;
- $R^{10}$ is hydrogen or $C_1$-$C_6$ alkyl;
- $R^{11}$ is hydrogen or $C_1$-$C_6$ alkyl;
- $R^{12}$ and $R^{13}$ are independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring;

R$^{14}$ is hydrogen or C$_1$-C$_6$ alkylene, -(L$^5$)-aryl, -(L$^5$)-heteroaryl, —NR$^{17}$R$^{18}$, R$^{14}$ and R$^{19}$ are joined together along with the other atoms to which they are attached to form a 5-membered or 6-membered carbocyclic or heterocyclic ring, or R$^{14}$ and R$^{20}$ are joined together along with the other atoms to which they are attached to form a 5-membered or 6-membered carbocyclic or heterocyclic ring;

L$^5$ is a bond, C$_1$-C$_{10}$ alkylene, —O—, —NR$^{10}$—;

R$^{17}$ and R$^{18}$ are each independently hydrogen or aryl;

R$^{19}$ and R$^{20}$ are independently selected from hydrogen, C$_1$-C$_6$ alkyl, R$^{14}$ and R$^{19}$ are joined together along with the other atoms to which they are attached to form a 5-membered or 6-membered carbocyclic or heterocyclic ring, or R$^{14}$ and R$^{20}$ are joined together along with the other atoms to which they are attached to form a 5-membered or 6-membered carbocyclic or heterocyclic ring;

n is 0, 1, 2, or 3;
m is 0, 1, 2, or 3;
p is 0, 1, 2, or 3;
q is 0, 1, 2, or 3;
x is 0 or 1; and A$^1$ is a polypeptide having at least 85% sequence identity with MCMPCFTTDHQMARRCDDCCGGR-GRGKCYGPQCLCR or a fragment thereof.

In other aspects, compounds of the present disclosure have a structure of Formula (V), or a pharmaceutically acceptable salt thereof:

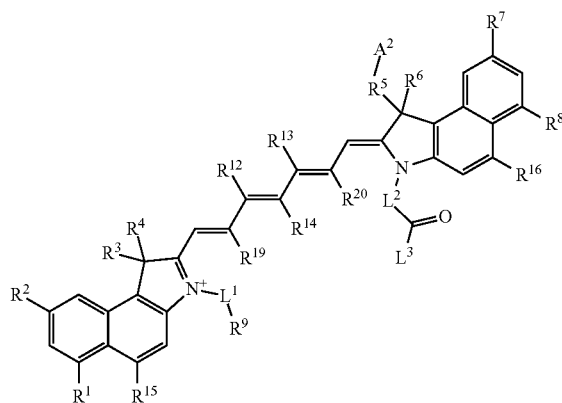

(V)

wherein:
R$^1$, R$^2$, R$^3$, R$^4$, R$^6$, R$^7$, R$^8$, R$^{15}$, and R$^{16}$ are each independently selected from hydrogen, C$_1$-C$_6$ alkyl, C$_1$-C$_6$ alkylene-COOH, sulfonate, —COOH, —SO$_2$—NH$_2$, or C$_1$-C$_6$ alkoxy;

R$^5$ is selected from C$_1$-C$_{10}$ alkylene-(C(=O))$_x$—, C$_1$-C$_{10}$ alkylene-(C(=O))$_x$—O—, or C$_1$-C$_{10}$ alkylene-(C(=O))$_x$—NR$^{10}$—;

R$^9$ is hydrogen, sulfonate, or —COOH, or C$_1$-C$_{10}$ alkyl;

L$^1$ is C$_3$-C$_6$ alkylene;
L$^2$ is C$_1$-C$_{10}$ alkylene;
L$^3$ is hydrogen, sulfonate, —COOH, or C$_1$-C$_{10}$ alkyl;
L$^4$ is a bond, -heterocyclyl-, or -heterocyclyl-C$_1$-C$_6$ alkylene-;

R$^{10}$ is hydrogen or C$_1$-C$_6$ alkyl;
R$^{11}$ is hydrogen or C$_1$-C$_6$ alkyl;
R$^{12}$ and R$^{13}$ are independently selected from hydrogen, C$_1$-C$_6$ alkyl, or R$^{12}$ and R$^{13}$ are joined along with the other atoms to which they are attached to form a 5-membered or 6-membered carbocyclic or heterocyclic ring;

R$^{14}$ is hydrogen or C$_1$-C$_6$ alkylene, -(L$^5$)-aryl, -(L$^5$)-heteroaryl, —NR$^{17}$R$^{18}$, R$^{14}$ and R$^{19}$ are joined together along with the other atoms to which they are attached to form a 5-membered or 6-membered carbocyclic or heterocyclic ring, or R$^{14}$ and R$^{20}$ are joined together along with the other atoms to which they are attached to form a 5-membered or 6-membered carbocyclic or heterocyclic ring;

L$^5$ is a bond, C$_1$-C$_{10}$ alkylene, —O—, —NR$^{10}$—;

R$^7$ and R$^{18}$ are each independently hydrogen or aryl;

R$^{19}$ and R$^{20}$ are independently selected from hydrogen, C$_1$-C$_6$ alkyl, R$^{14}$ and R$^{19}$ are joined together along with the other atoms to which they are attached to form a 5-membered or 6-membered carbocyclic or heterocyclic ring, or R$^{14}$ and R$^{20}$ are joined together along with the other atoms to which they are attached to form a 5-membered or 6-membered carbocyclic or heterocyclic ring;

n is 0, 1, 2, or 3;
m is 0, 1, 2, or 3;
p is 0, 1, 2, or 3;
q is 0, 1, 2, or 3;
x is 0 or 1; and A$^2$ is a polypeptide having at least 85% sequence identity with MCMPCFTTDHQMARRCDDCCGGR-GRGKCYGPQCLCR or a fragment thereof.

In some aspects, compounds of the present disclosure have a structure of Formula (VI), or a pharmaceutically acceptable salt thereof:

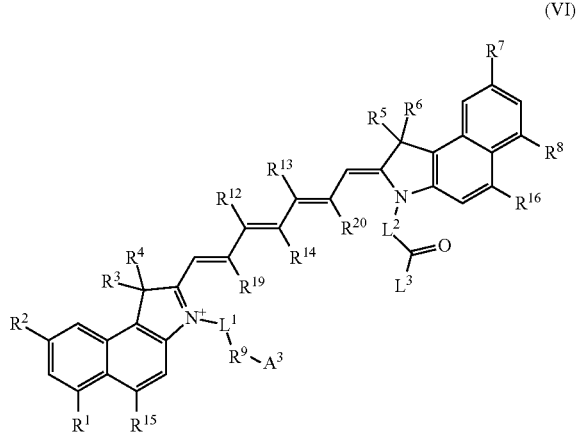

(VI)

wherein:
R$^1$, R$^2$, R$^3$, R$^4$, R$^5$, R$^6$, R$^7$, R$^8$, R$^{15}$, and R$^{16}$ are each independently selected from hydrogen, C$_1$-C$_6$ alkyl, C$_1$-C$_6$ alkylene-COOH, sulfonate, —COOH, —SO$_2$—NH$_2$, or C$_1$-C$_6$ alkoxy;

R$^9$ is selected from C$_1$-C$_{10}$ alkylene-(C(=O))$_x$—, C$_1$-C$_{10}$ alkylene-(C(=O))$_x$—O—, or C$_1$-C$_{10}$ alkylene-(C(=O))$_x$—NR$^{10}$—;

L$^1$ is C$_3$-C$_6$ alkylene;
L$^2$ is C$_1$-C$_{10}$ alkylene;
L$^3$ is hydrogen, sulfonate, —COOH, or C$_1$-C$_{10}$ alkyl;
L$^4$ is a bond, -heterocyclyl-, or -heterocyclyl-C$_1$-C$_6$ alkylene-;

R$^{10}$ is hydrogen or C$_1$-C$_6$ alkyl;
R$^{11}$ is hydrogen or C$_1$-C$_6$ alkyl;

$R^{12}$ and $R^{13}$ are independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring;

$R^{14}$ is hydrogen or $C_1$-$C_6$ alkylene, -($L^5$)-aryl, -($L^5$)-heteroaryl, —$NR^{17}R^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;

$R^{17}$ and $R^{18}$ are each independently hydrogen or aryl;

$R^{19}$ and $R^{20}$ are independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;

n is 0, 1, 2, or 3;
m is 0, 1, 2, or 3;
p is 0, 1, 2, or 3;
q is 0, 1, 2, or 3;
x is 0 or 1;
$L^5$ is a bond, $C_1$-$C_{10}$ alkylene, —O—, —$NR^{10}$—;
$A^3$ is a polypeptide having at least 85% sequence identity with MCMPCFTTDHQMARRCDDCCGGR-GRGKCYGPQCLCR or a fragment thereof.

In additional aspects, compounds of the present disclosure have a structure Formula (III), or a pharmaceutically acceptable salt thereof:

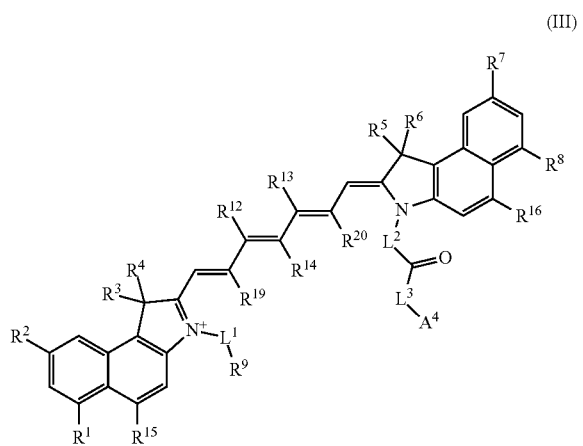

(III)

wherein:
$R^1$, $R^2$, $R^3$, $R^4$, $R^5$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —$SO_2$—$NH_2$, or $C_1$-$C_6$ alkoxy;
$R^9$ is hydrogen, sulfonate, or —COOH;
$L^1$ is $C_3$-$C_6$ alkylene;
$L^2$ is $C_1$-$C_{10}$ alkylene;
$L^3$ is a bond, —O—, —$NR^{10}$—, —$NR^{10}$—$C_1$-$C_6$ alkylene-, —O—$NR^{10}$—, —$NR^{10}$—$C_1$-$C_6$ alkylene-(O—$C_1$-$C_6$ alkylene)$_n$-, —$NR^{10}$-$L^4$-, —$NR^{10}$—$C_1$-$C_6$ alkylene-$NR^{11}$—(C(=O)—$C_1$-$C_6$ alkylene-O—)$_m$—, or —$NR^{10}$—$C_1$-$C_6$ alkylene-$NR^{10}$—$C_1$-$C_6$ alkylene-$NR^{10}$—$C_1$-$C_6$ alkylene-;

$L^4$ is a bond, -heterocyclyl-, or -heterocyclyl-$C_1$-$C_6$ alkylene-;
$R^{10}$ is hydrogen or $C_1$-$C_6$ alkyl;
$R^{11}$ is hydrogen or $C_1$-$C_6$ alkyl;
$R^{12}$ and $R^{13}$ are independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring;
$R^{14}$ is -($L^5$)-aryl-$A^5$, or -($L^5$)-heteroaryl-$A^5$;
$L^5$ is a bond, $C_1$-$C_{10}$ alkylene, —O—, —$NR^{10}$—;
$R^7$ and $R^{18}$ are each independently hydrogen or aryl;
$R^{19}$ and $R^{20}$ are independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;
n is 0, 1, 2, or 3;
m is 0, 1, 2, or 3;
p is 0, 1, 2, or 3;
q is 0, 1, 2, or 3;
x is 0 or 1;
$A^4$ is hydrogen, —COOH, or sulfonate; and
$A^5$ is a polypeptide having at least 85% sequence identity with MCMPCFTTDHQMARRCDDCCGGR-GRGKCYGPQCLCR or a fragment thereof.

In various aspects, the present disclosure provides a kit comprising vessel configured to contain a fluid; any of the compounds and compositions described herein; and an elastomeric closure affixed to the vessel.

In various aspects, the present disclosure provides a composition comprising a compound comprising a polypeptide having at least 85% sequence identity with MCMPCFTTDHQMARRCDDCCGGR-GRGKCYGPQCLCR or a fragment thereof, wherein when the composition is intravenously administering to a human subject at a dose of from 1 mg to 30 mg, the composition produces in the human subject an average maximum compound blood plasma concentration (average $C_{max}$) of at least from 110 ng/mL to 240 ng/mL per each 1 mg dosage of the compound administered.

In various aspects, the present disclosure provides a method of administering a composition to a human subject, the method comprising: intravenously administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof; and producing in the human subject an average maximum compound blood plasma concentration (average $C_{max}$) of at least from 110 ng/mL to 240 ng/mL per each 1 mg dosage of the compound administered.

In various aspects, the present disclosure provides a method of detecting a cancer cell in a human subject, the method comprising: intravenously administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof conjugated to a detectable label; producing in the human subject an average maximum compound blood plasma concentration (average $C_{max}$) of at least from 110 ng/mL to 240 ng/mL per each 1 mg dosage of the compound administered; and detecting the presence or absence of the detectable label in the human subject, wherein the presence of the detectable label indicates the presence of the cancer cell.

In various aspects, the present disclosure provides a method of diagnosing cancer in a human subject, the method comprising: intravenously administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof conjugated to a detectable label; producing in the human subject an average maximum compound blood plasma concentration (average $C_{max}$) of at least from 110 ng/mL to 240 ng/mL per each 1 mg dosage of the compound administered; and detecting the presence or absence of the detectable label in the human subject, wherein the presence of the detectable label indicates a diagnosis of cancer.

In various aspects, the present disclosure provides a method of treating cancer in a human subject, the method comprising: intravenously administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof conjugated to a therapeutic agent; producing in the human subject an average maximum compound blood plasma concentration (average $C_{max}$) of at least from 110 ng/mL to 240 ng/mL per each 1 mg dosage of the compound administered; and reducing or improving a symptom or condition associated with cancer in the human subject. In some aspects, the human subject is in need thereof. In some aspects, the methods comprise administering a therapeutically effective dose of the compound to the human subject.

In various aspects, the present disclosure provides a method of administering a composition to a human subject, the method comprising: administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof; and producing in the human subject pharmacokinetic profile of FIG. 27.

In various aspects, the present disclosure provides a method of administering a composition to a human subject, the method comprising: intravenously administering to the human subject a dose of from 1 mg to 30 mg of any suitable compound of the present disclosure; and producing in the human subject an average maximum compound blood plasma concentration (average $C_{max}$) of at least from 110 ng/mL to 240 ng/mL per each 1 mg dosage of the compound administered.

In various aspects, the present disclosure provides a method for detecting a cancer cell in a subject, the method comprising: administering any suitable compound of the present disclosure; and detecting the presence or absence of the compound in the subject, wherein the presence of the compound indicates the presence of a cancer cell.

In various aspects, the present disclosure provides a method of administering any suitable compound of the present disclosure to a subject, the method comprising administering a therapeutically effective amount of the compound to the subject.

In various aspects, the present disclosure provides a method of treating a subject in need thereof, the method comprising administering to the subject any suitable compound of the present disclosure further comprising a therapeutic agent in an amount sufficient to treat cancer in the subject. In certain aspects, the therapeutic agent is a cytotoxic agent.

In one embodiment, the chlorotoxin conjugate comprises a chemotherapeutic, an anti-cancer agent, or an anti-cancer drug. In another embodiment, the chlorotoxin conjugate comprising the chemotherapeutic, an anti-cancer agent, or an anti-cancer drug is administered after the central or primary tumor is detected during surgery. In a further embodiment, the central or primary tumor is detected with a chlorotoxin conjugated to a labeling agent.

In another aspect is provided a method of inhibiting, preventing, minimizing, shrinking, or killing cells, or preventing metastasis in residual tumor cells in a tumor bed in an individual, comprising the step of administering a chlorotoxin conjugate to the individual wherein the chlorotoxin conjugate binds to the residual tumor cells in a tumor bed; and whereby the residual tumor cells in the tumor bed are inhibited, prevented, minimized, shrinked, or killed cells, or metastasis is prevented. In one embodiment, the chlorotoxin conjugate comprises a chemotherapeutic, an anti-cancer agent, or an anti-cancer drug. In another embodiment, the chlorotoxin conjugate comprising the chemotherapeutic, an anti-cancer agent, or an anti-cancer drug is administered after the central or primary tumor is detected during surgery. In a further embodiment, the central or primary tumor is detected with a chlorotoxin conjugated to a labeling agent.

In another aspect the invention provides, a method of administering a chlorotoxin conjugated to a chemotherapeutic, an anti-cancer agent, or an anti-cancer drug to an individual to treat, inhibit, prevent, minimize, shrink, or kill cells, or prevent metastasis in cells that are identified with a chlorotoxin conjugated to a labeling agent. In some embodiments the anti-cancer agent include antibodies, polypeptides, polysaccharides, and nucleic acids. In an embodiment, the chlorotoxin conjugate is administered about 1 day before the surgery. In another embodiment, the chlorotoxin conjugate is administered about 2 days before surgery. In another embodiment, the chlorotoxin conjugate is administered in multiple sub-doses. In an embodiment, the chlorotoxin conjugate is administered in about 2 sub-doses, 3 sub-doses, 4 sub-doses, or more sub-doses. In another embodiment, the chlorotoxin conjugate comprising the chemotherapeutic, an anti-cancer agent, or an anti-cancer drug is administered after the central or primary tumor is detected during surgery. In a further embodiment, the central or primary tumor is detected with a chlorotoxin conjugated to a labeling agent.

In one aspect, the invention provides a method of detecting soft-tissue sarcoma in an individual, comprising the steps of: a) administering a chlorotoxin conjugate to the individual wherein the chlorotoxin conjugate binds to the soft-tissue sarcoma; and b) imaging, visualizing, or analyzing the bound chlorotoxin conjugate. In an embodiment, the detecting comprises in vivo, or ex vivo detecting. In another embodiment, the imaging, visualizing, or analyzing comprises visualizing the chlorotoxin conjugate. In a further embodiment, the imaging, visualizing, or analyzing comprises in vivo, or ex vivo imaging, visualizing, or analyzing. In some embodiments, the visualizing comprises optically imaging the sarcoma. In some embodiments a plot is made of the fluorescent intensity of the chlorotoxin conjugate.

In an aspect, a chlorotoxin conjugate comprising one or more labeling agents is used in detecting the soft-tissue sarcoma. In an embodiment, the labeling agent comprises a fluorescent moiety. In a further embodiment, the fluorescent moiety comprises a near infrared fluorescent moiety. In another embodiment, the labeling agent comprises a radionuclide. In another embodiment, the soft-tissue sarcoma is selected from the group consisting of: trachea, fat tissue tumors, muscle tissue tumors, skeletal muscle sarcomas, rhabdomyosarcomas, peripheral nerve tumors, fibrous tissue tumors, myxofibrosarcomas, fibromatosis, joint tissue tumors, tumors of blood vessels and lymph vessels, angiosarcomas, gastrointestinal stromal tumors, alveolar soft part sarcoma, dermatofibrosarcoma protuberans (DFSP), desmoplastic small round cell tumour, epithelioid sarcoma, extra skeletal myxoid chondrosarcoma, and giant cell fibroblastoma (GCF).

In another aspect a chlorotoxin conjugate is used to detect soft-tissue sarcoma in subcutaneous fatty tissue. In an embodiment, the detecting comprises imaging, visualizing, or analyzing the chlorotoxin conjugate during or related to surgery, surgical resection, or intraoperative imaging and resection. In another embodiment, the sarcoma, or a portion thereof, is removed during or related to surgery.

The invention provides a method of detecting cutaneous squamous cell carcinoma in an individual, comprising the steps of: a) administering a chlorotoxin conjugate to the individual, wherein the chlorotoxin conjugate binds to the cutaneous squamous cell carcinoma; and b) imaging, visualizing, or analyzing the bound chlorotoxin conjugate. In an embodiment, the detecting comprises in vivo, or ex vivo detection. In another embodiment, the imaging, visualizing, or analyzing comprises visualizing the chlorotoxin conjugate. In another embodiment, the imaging, visualizing, or analyzing comprises in vivo, or ex vivo imaging, visualizing, or analyzing.

In another aspect, the invention provides a method of using a chlorotoxin conjugate to optically image cutaneous squamous cell carcinoma. In an embodiment, the chlorotoxin conjugate comprises one or more labeling agents. In another embodiment, the labeling agent comprises a fluorescent moiety. In a further embodiment, the fluorescent moiety comprises a near infrared fluorescent moiety. In another embodiment, the labeling agent comprises a radionuclide. In some embodiments, the detecting comprises imaging, visualizing, or analyzing the chlorotoxin conjugate during or related to surgery, surgical resection, or intraoperative imaging and resection. In some embodiments, the cutaneous squamous cell carcinoma, or a portion thereof, is removed during or related to surgery. In some embodiments the fluorescent intensity of the chlorotoxin conjugate is made.

In an aspect the invention provides a method of detecting a low-grade tumor in an individual, comprising the steps of: a) administering a chlorotoxin conjugate to the individual wherein the chlorotoxin conjugate binds to the low-grade tumor; and b) imaging, visualizing, or analyzing the bound chlorotoxin conjugate. In an embodiment, the detecting comprises in vivo, or ex vivo detecting. In some embodiments, the imaging, visualizing, or analyzing comprises vivo, or ex vivo imaging, visualizing, or analyzing.

The invention provides a method of using a chlorotoxin conjugate to optically image a low-grade tumor. In an embodiment, the chlorotoxin conjugate comprises one or more labeling agents. In an embodiment, the labeling agent comprises a fluorescent moiety. In an embodiment, the fluorescent moiety comprises a near infrared fluorescent moiety. In another embodiment, the labeling agent comprises a radionuclide. In another embodiment, the detecting is performed during or related to surgery or resection. In a further embodiment, the low-grade tumor, or a portion thereof, is removed during or related to surgery, surgical resection, or intraoperative imaging and resection. In some embodiments, the low-grade tumor is selected from the group consisting of: a) a low-grade tumor in or from brain tissue; b) a low-grade tumor in or from subcutaneous fatty tissue; c) a low-grade tumor in or from breast or mammary tissue, and d) a low-grade tumor in or from lung tissue. In some embodiments a plot is made of the fluorescent intensity of the chlorotoxin conjugate.

In an embodiment, the chlorotoxin conjugate comprises one or more labeling agents. In an embodiment, the labeling agent comprises a fluorescent moiety. In an embodiment, the fluorescent moiety comprises a near infrared fluorescent moiety. In another embodiment, the labeling agent comprises a radionuclide. In an embodiment, the detecting comprises in vivo, or ex vivo detection. In an embodiment, the imaging, visualizing, or analyzing comprises in vivo, or ex vivo imaging, visualizing, or analyzing. In some embodiments a plot is made of the fluorescent intensity of the chlorotoxin conjugate.

In another aspect, is provided a method for using a chlorotoxin conjugate to detect residual cancer in the tumor bed of an individual following removal of a primary or central tumor in breast cancer surgery, comprising: a) administering a chlorotoxin conjugate to the individual wherein the chlorotoxin conjugate binds to residual cancer; and b) imaging, visualizing, or analyzing the bound chlorotoxin conjugate. In an embodiment, the chlorotoxin conjugate comprises one or more labeling agents. In a further embodiment, the labeling agent comprises a fluorescent moiety. In another embodiment, the fluorescent moiety comprises a near infrared fluorescent moiety. In another embodiment, the labeling agent comprises a radionuclide. In some embodiments the detecting is performed during or related to surgery or resection. In further embodiments, the residual cancer, or a portion thereof, is removed during or related to surgery, surgical resection, or intraoperative imaging and resection.

In an embodiment, the chlorotoxin conjugate comprises one or more labeling agents. In a further embodiment, the labeling agent comprises a fluorescent moiety. In another embodiment, the fluorescent moiety comprises a near infrared fluorescent moiety. In another embodiment, the labeling agent comprises a radionuclide. In an aspect, the invention provides, a method for detecting a tumor in an individual comprising the steps of: a) administering a chlorotoxin conjugate to the individual wherein the chlorotoxin conjugate binds to the tumor; and b) imaging, visualizing, or analyzing the bound chlorotoxin conjugate wherein the chlorotoxin conjugate is administered in an amount of between about 0.9 mg/m$^2$ to about 1.1 mg/m$^2$ or in an amount of between about 3 mg to about 6 mg. In an embodiment, the detecting comprises vivo, or ex vivo detection. In some embodiments, the imaging, visualizing, or analyzing comprises in vivo, or ex vivo imaging, visualizing, or analyzing.

The invention provides a method of using a chlorotoxin conjugate to optically image a tumor, in an embodiment, the chlorotoxin conjugate comprises one or more labeling agents. In a father embodiment, the labeling agent comprises a fluorescent moiety. In a further embodiment, the fluorescent moiety comprises a near infrared fluorescent moiety. In another embodiment, the labeling agent comprises a radionuclide. In some embodiments the detecting is performed during or related to surgery or resection. In some embodiments, the tumor, or a portion thereof, is removed during or related to surgery surgical resection, or intraoperative imaging and resection.

The invention provides methods of administering a chlorotoxin conjugate to an individual to detect soft-tissue sarcoma, low-grade tumor, cutaneous squamous cell carcinoma, or cells therefrom, in tumors of skin or breast, and lung and mammary cancers. In an embodiment, the chlorotoxin conjugate comprises one or more labeling agents. In an embodiment, the labeling agent comprises a fluorescent moiety. In an embodiment, the fluorescent moiety comprises a near infrared fluorescent moiety. In another embodiment, the labeling agent comprises a radionuclide. In another embodiment, the detecting is performed during or related to surgery or resection. In a further embodiment, the soft-tissue sarcoma, low-grade tumor, cutaneous squamous cell carcinoma, or cells therefrom, in tumors of skin or breast, and lung and mammary cancers, or a portion thereof, is removed during or related to surgery, surgical resection, or intraoperative imaging and resection. In other embodiments, the chlorotoxin conjugate is administered in an amount of between about 0.9 mg/m$^2$ to about 1.1 mg/m$^2$ or in an amount of between about 3 mg to about 6 mg. In an embodiment, the chlorotoxin conjugate is administered about 1 day before the surgery. In another embodiment, the chlorotoxin conjugate is administered about 2 days before surgery. In another embodiment, the chlorotoxin conjugate is administered in multiple sub-doses. In an embodiment, the chlorotoxin conjugate is administered in about 2 sub-doses, 3 sub-doses, 4 sub-doses, or more sub-doses. In an embodiment, the detecting comprises in vivo, or ex vivo detection. In some embodiments, the imaging, visualizing, or analyzing comprises in vivo, or ex vivo imaging, visualizing, or analyzing. In some embodiments a plot is made of the fluorescent intensity of the chlorotoxin conjugate.

In another aspect, is provided a method for using a chlorotoxin conjugate to detect residual cancer in the tumor bed of an individual following removal of a primary or central tumor in breast cancer surgery, comprising: a) administering a chlorotoxin conjugate to the individual wherein the chlorotoxin conjugate binds to residual cancer; and b) imaging, visualizing, or analyzing the bound chlorotoxin conjugate. In an embodiment, the chlorotoxin conjugate comprises one or more labeling agents. In a further embodiment, the labeling agent comprises a fluorescent moiety. In another embodiment, the fluorescent moiety comprises a near infrared fluorescent moiety. In another embodiment, the labeling agent comprises a radionuclide. In some embodiments the detecting is performed during or related to surgery or resection. In further embodiments, the residual cancer, or a portion thereof, is removed during or related to surgery, surgical resection, or intraoperative imaging and resection.

In an embodiment, the chlorotoxin conjugate comprises one or more labeling agents. In an embodiment, the labeling agent comprises a fluorescent moiety. In an embodiment, the fluorescent moiety comprises a near infrared fluorescent moiety. In another embodiment, the labeling agent comprises a radionuclide. In another embodiment, the detecting is performed during or related to surgery or resection. In an embodiment, the chlorotoxin conjugate is administered about 1 day before the surgery. In another embodiment, the chlorotoxin conjugate is administered about 2 days before surgery. In another embodiment, the chlorotoxin conjugate is administered in multiple sub-doses. In an embodiment, the chlorotoxin conjugate is administered in about 2 sub-doses, 3 sub-doses, 4 sub-doses, or more sub-doses. In an embodiment, the detecting comprises vivo, or ex vivo detection. In some embodiments, the imaging, visualizing, or analyzing comprises in vivo, or ex vivo imaging, visualizing, or analyzing. In some embodiments a plot is made of the fluorescent intensity of the chlorotoxin conjugate.

The invention further provides methods for detecting soft tissue sarcoma in an individual comprising, administering a chlorotoxin conjugate to the individual, wherein the chlorotoxin conjugate comprises a detectable agent and a chlorotoxin polypeptide having at least 85% sequence identity with MCMPCFTTDHQMARXCDDCCGGXGRGXCYGPQCL-CR, binding the chlorotoxin conjugate to the soft tissue sarcoma, and detecting the bound chlorotoxin conjugate, wherein an elevated level of bound chlorotoxin conjugate indicates the presence of soft tissue sarcoma.

Also described herein are peptides that selectively bind to cancer cells. These peptides may be conjugated to a fluorescent moiety, such as an indocyanine green molecule, to form a peptide conjugate that selectively binds to cancer cells. Methods of selectively labeling cancer cells may utilize a peptide conjugate comprising a tumor-homing peptide and a fluorescent moiety.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 10A-10C shows biodistribution analysis of Compound 76-5 kD. FIG. 10A shows integrated intensity for sections from liver, kidney, spleen, heart and brain. FIGS. 10B and 10C show representative images from liver and kidney, respectively.

FIG. 13A-FIG. 13C shows biodistribution of select tissues using the IVIS Spectrum imaging system. FIG. 13A represents tissues one day after injection. FIG. 13B shows tissues imaged three days post injection. (B—brain, H—heart, K—kidney, S—skin, L—liver). FIG. 13C shows fluorescent signal in tissues for the 2 nmol and 20 nmol groups one and three days after injection.

FIG. 38A-FIG. 38C illustrates alignment of SEQ ID NO: 1025 (SEQ ID NO: 1025 is SEQ ID NO: 511, but without the first three amino acids "GSG" and is also SEQ ID NO: 801, but without the first amino acid "G") with SEQ ID NO: 800, SEQ ID NO: 1025 with SEQ ID NO: 1026 (SEQ ID NO: 1026 is SEQ ID NO: 514, but without the first three amino acids "GSQ" and is SEQ ID NO: 804, but without the first amino acid "Q"), and SEQ ID NO: 1025 with SEQ ID NO: 967. FIG. 38A illustrates the alignment of the peptide of SEQ ID NO: 1025 with the peptide of SEQ ID NO: 800. Boxes delineate conserved positively charged residues. FIG. 38B illustrates the alignment of the peptide of SEQ ID NO: 1025 with the peptide of SEQ ID NO: 1026. Boxes delineate conserved positively charged residues. FIG. 38C illustrates the alignment of the peptide of SEQ ID NO: 1025 with the peptide of SEQ ID NO: 967. Boxes delineate conserved positively charged residues.

FIG. 39 illustrates the alignment of the peptide of SEQ ID NO: 804 with the peptide of SEQ ID NO: 968. Boxes delineate conserved positively charged residues.

FIG. 40 illustrates alignment of peptides within the pfam00451:toxin_2 structural class family of SEQ ID NO: 978-SEQ ID NO: 1024. Boxed and bolded residues indicate relative conservation of sequence while non-boxed and non-bolded residues indicate areas of higher sequence variability.

FIG. 41 illustrates alignment of a peptide of SEQ ID NO: 978 from the pfam00451:toxin 2 structural class family with a cartilage homing peptide of this disclosure of SEQ ID NO: 511. Asterisks indicate positions with a single, fully conserved residue, a colon indicates conservation between groups of strongly similar properties (scoring >0.5 in the Gonnet point accepted mutation (PAM) 250 matrix), and a period indicates conservation between groups of weakly similar properties (scoring ≤0.5 in the Gonnet PAM 250 matrix).

FIG. 43A illustrates an image of a frozen section of a mouse, 24 hours after administration of 10 nmol of a peptide of SEQ ID NO: 592 conjugated to a Cy5.5 fluorophore (SEQ ID NO: 592A). FIG. 43B illustrates the fluorescence signal in the mouse, corresponding to the section shown in FIG. 43A, 24 hours after administration of 10 nmol of a peptide of SEQ ID NO: 592 conjugated to a Cy5.5 fluorophore (SEQ ID NO: 592A). FIG. 43C illustrates an image of a different frozen section of the mouse, 24 hours after administration of 10 nmol of a peptide of SEQ ID NO: 592 conjugated to a Cy5.5 fluorophore (SEQ ID NO: 592A). FIG. 43D illustrates the fluorescence signal in the mouse, corresponding to the section shown in FIG. 43C, 24 hours after administration of 10 nmol of a peptide of SEQ ID NO: 592 conjugated to a Cy5.5 fluorophore (SEQ ID NO: 592A). FIG. 43E illustrates an image of a different frozen section of the mouse, 24 hours after administration of 10 nmol of a peptide of SEQ ID NO: 592 conjugated to a Cy5.5 fluorophore (SEQ ID NO: 592A). FIG. 43F illustrates a fluorescence signal in the mouse, corresponding to the section shown in FIG. 43E, 24 hours after administration of 10 nmol of a peptide of SEQ ID NO: 592 conjugated to a Cy5.5 fluorophore (SEQ ID NO: 592A).

FIG. 44 illustrates a multiple sequence alignment of SEQ ID NO: 800, SEQ ID NO: 801, SEQ ID NO: 805, SEQ ID NO: 817, SEQ ID NO: 821, SEQ ID NO: 822, SEQ ID NO: 824, SEQ ID NO: 882, SEQ ID NO: 958, SEQ ID NO: 967, SEQ ID NO: 970, and SEQ ID NO: 1027-SEQ ID NO: 1033 were used to predict enhanced peptide stability and immunogenicity. SEQ ID NO: 779 is a consensus sequence.

FIG. 46A-FIG. 46H shows IVIS fluorescence imaging of an isolated hind limb from a first mouse and an isolated hind limb from a second mouse after administration of 10 nmol SEQ ID NO: 592 peptide conjugated to a Cy5.5 fluorophore (SEQ ID NO: 592A). Areas of low signal intensity are shown in a thin solid line, areas of medium signal intensity are shown in a thick sold line, and areas of high signal intensity are shown in a thin dotted line. FIG. 46A shows the right hind limb with skin removed from a first mouse and from a second mouse 3 hours after peptide administration. FIG. 46B shows the right hind limb with muscle removed from a first mouse and from a second mouse 3 hours after peptide administration of 10 nmol SEQ ID NO: 592 peptide conjugated to a Cy5.5 fluorophore (SEQ ID NO: 592A). FIG. 46C shows the right hind limb with skin removed from a first mouse and from a second mouse 24 hours after peptide administration of 10 nmol SEQ ID NO: 592 peptide conjugated to a Cy5.5 fluorophore (SEQ ID NO: 592A). FIG. 46D shows the right hind limb with muscle removed from a first mouse and from a second mouse 24 hours after peptide administration of 10 nmol SEQ ID NO: 592 peptide conjugated to a Cy5.5 fluorophore (SEQ ID NO: 592A). FIG. 46E shows the right hind limb with skin removed from a first mouse and from a second mouse 48 hours after peptide administration of 10 nmol SEQ ID NO: 592 peptide conjugated to a Cy5.5 fluorophore (SEQ ID NO: 592A). FIG. 46F shows the right hind limb with muscle removed from a first mouse and from a second mouse 48 hours after peptide administration of 10 nmol SEQ ID NO: 592 peptide conjugated to a Cy5.5 fluorophore (SEQ ID NO: 592A). FIG. 46G shows the right hind limb with skin removed from a first mouse and from a second mouse 72 hours after peptide administration of 10 nmol SEQ ID NO: 592 peptide conjugated to a Cy5.5 fluorophore (SEQ ID NO: 592A). FIG. 46H shows the right hind limb with muscle removed from a first mouse and from a second mouse 72 hours after administration of 10 nmol SEQ ID NO: 592 peptide conjugated to a Cy5.5 fluorophore (SEQ ID NO: 592A).

FIG. 47A illustrates the $^{14}$C signal in a different frozen section of the mouse, 3 hours after administration of 100 nmol of a radiolabeled peptide of SEQ ID NO: 592. FIG. 47B illustrates the $^{14}$C signal in a different frozen section of a mouse, 3 hours after administration of 100 nmol of a radiolabeled peptide of SEQ ID NO: 592.

FIG. 48A illustrates the $^{14}$C signal in a frozen section of a mouse. FIG. 48B illustrates the $^{14}$C signal in a frozen section of the mouse, 3 hours after administration of 100 nmol of a radiolabeled peptide of SEQ ID NO: 590.

FIG. 49A illustrates the $^{14}$C signal in a frozen section of the mouse, 3 hours after administration of 100 nmol of a radiolabeled peptide of SEQ ID NO: 671. FIG. 49B illustrates the $^{14}$C signal in a frozen section of the mouse, 3 hours after administration of 100 nmol of a radiolabeled peptide of SEQ ID NO: 671.

DETAILED DESCRIPTION

Figure 1A:
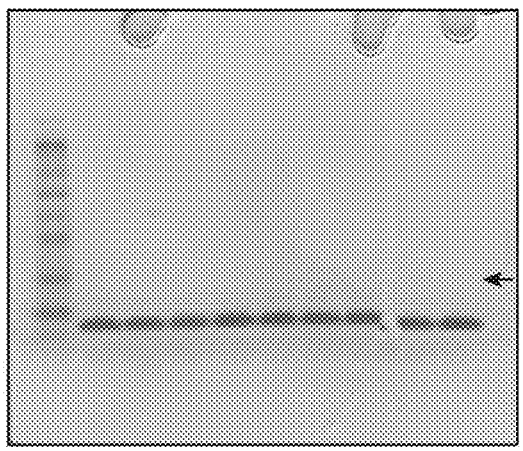
FIG. 1A-FIG. 1C shows SDS-PAGE of chlorotoxin conjugate formulations after 14 days at room temperature.

The present disclosure relates generally to compositions and methods for cartilage therapy. In some embodiments, the compositions and methods herein utilize peptides that home, target, are directed to, are retained by, accumulate in, migrate to, and/or bind to cartilage following administration to a subject. In some embodiments, the cartilage homing peptides of the present disclosure exert therapeutic effect in cartilage or tissue or cell thereof. In some embodiments, the cartilage homing peptides of the present disclosure are used to deliver an active agent to cartilage or tissue or cell thereof. The active agent can exert a therapeutic effect on cartilage or tissue or cell thereof. For example, in certain embodiments, the peptide itself or the active agent allows for localized delivery of an anti-inflammatory or other agent to cartilage or tissue or cell thereof. As another example, the active agent is a fluorophore that can be used for imaging of cartilage. In certain embodiments, the peptide itself induces therapeutic responses.

Cartilage disorders are particularly difficult to treat. A direct route for active agent administration can be parenterally (e.g., intravenously, subcutaneously, intramuscularly), intra-articularly, by inhalation, dermally, topically, or orally. However, cartilage can be avascular thus intravenous administration of drugs can fail to reach the cartilage in significant amounts. Drugs for cartilage diseases, such as osteoarthritis, can be injected directly locally into the affected area, for example, directly injected into the joint. Few drugs aimed at treating cartilage disorders have proved therapeutically viable with lack of access to target tissue being a primary reason for failure. The lack of access to the target tissue can also lead to administration of doses that are higher than would be necessary if a drug could home, target, or be directed to, is retained by, and/or binds to a target region, tissue, structure or cell. Thus, treatment of cartilage conditions often requires the use of high concentrations of non-specific drugs. In addition, a number of therapeutics are of interest in treating joint disorders, but are problematic because of the level of side effects caused by systemic administration of the drug (Dancevic and McCulloch, *Arthritis Res Ther.* 16:429 (2014)).

Specific and potent drugs that are capable of contacting the cartilage can counteract the non-specificity of many treatments by selectively targeting and delivering compounds to specific regions, tissues, cells and structures. Such drugs can also be useful to modulate ion channels, protein-protein interactions, extracellular matrix remodeling (i.e., protease inhibition), and the like. Such targeted therapy can allow for lower dosing, reduced side effects, improved patient compliance, and improvement in therapeutic outcomes, which would be advantageous not only in acute disease of the cartilage, but in chronic conditions as well.

The present disclosure provides peptides that can comprise or can be derived from cystine-dense peptides. As used herein, the term "cystine-dense peptide" can be interchangeable with the terms "knotted peptide," "knottin," and "optide," and cystine-dense peptides can also be abbreviated as "CDPs." Hitchins, amongst other disulfide-containing peptides, can also be considered "knotted peptides" or "cystine-dense peptides" for the purposes of this disclosure. Knottins, for example, are a class of cystine-dense peptides comprising from about 11 to about 80 amino acids in length that are often folded into a compact structure. Knottins and other cystine-dense peptides are typically assembled into a complex tertiary structure that is characterized by a number of intramolecular disulfide crosslinks and can contain beta strands, an alpha helix, and other secondary structures. The presence of the disulfide bonds can give cystine-dense peptides remarkable environmental stability, allowing them to withstand extremes of temperature and pH, to resist proteolytic enzymes in the blood stream or digestive tract, and can provide specific biodistribution, pharmacokinetic, binding interactions, cellular processing, or other properties of physiologic and therapeutic value. The peptides disclosed herein can be derived from certain cystine-dense peptides. The present disclosure describes a class of cystine-dense peptides that can effectively contact cartilage and be used either directly or as carriers of active drugs, peptides, or molecules to treat a cartilage condition. For instance, osteoarthritis is a cartilage condition that is associated with the thinning of cartilage covering the ends of bones resulting in bone directly contacting bone within the joint. Over time, the ends of the bones are subjected to increased levels of friction which ultimately causes erosion of the end of the bone. Individuals suffering from osteoarthritis experience reduced motion and increased pain. A therapeutic peptide that could contact the cartilage at the joint and ends of the bone to interact with the chondrocytes and induce increased expression of extracellular matrix proteins could be used in the treatment and prevention of osteoarthritis by increasing expression of collagen through, for example, the rate of production, amount of production, inhibition of proteins which degrade collagen, promote expression of other proteins which maintain the integrity of existing collagen proteins, or other mechanism. A peptide could also affect nearby tissues or cells such as the bone, ligaments, muscle, tendons, bursa, connective tissue, blood vessels, peripheral nerves, osteoclasts, osteoblasts, fibroblasts, synoviocytes, monocytes/macrophages, lymphocytes, plasma cells, adipocytes, endothelial cells, neurons, ligaments, muscle, tendons, and bursa. The peptides of the disclosure can be used to treat the symptoms of various conditions. The peptides of the disclosure can bind to, home to, migrate to, accumulate in, be retained by, or be directed to cartilage and its components, including chondrocytes, extracellular matrix, collagen, hyaluranon, aggrecan (also known as cartilage-specific proteoglycan core protein (CSPCP)), or other components of the extracellular matrix and the joint, or to other nearby components such as those described herein in joints and cartilaginous tissues as listed above.

Also described herein are peptides that selectively home, target, are directed to, migrate to, are retained by, or accumulate in and/or bind to specific regions, tissues, structures or cells of the cartilage that aid in managing, decreasing, ablating or reducing pain (e.g., joint pain) due to chronic disease or cartilage injury or other therapeutic indications as described herein. A peptide that homes, targets, migrates to, is directed to, is retained by, or accumulates in and/or binds to one or more specific regions, tissues, structures or cells of the cartilage can have fewer off-target and potentially negative effects, for example, side effects that often limit use and efficacy of pain drugs. In addition, such peptides can reduce dosage and increase the efficacy of existing drugs by directly targeting them to a specific region, tissue, structure or cell of the cartilage and helping the contact the cartilage or increasing the local concentration of agent. The peptide itself can modulate pain or it can be conjugated to an agent that modulates pain. Such pain modulation may operate by various mechanisms such as modulating inflammation, autoimmune responses, direct or indirect action on pain receptors, cell killing, or programmed cell death (whether via an apoptotic and/or non-apoptotic pathway of diseased cells or tissues, and the like (Tait et al., *J Cell Sci* 127(Pt 10):2135-44 (2014)).

Peptides of this disclosure that home, target, are directed to, migrate to, are retained by, accumulate in, or bind to specific regions, tissues, structures or cells of the cartilage can do so with different degrees of efficiency. Peptides can have a higher concentration in cartilage than in other locations, such as blood or muscle. Peptides can be recorded as having a signal in cartilage as a percentage of signal in blood. For example, a cartilage signal of 200% indicates that the signal in cartilage is twice as high as the signal in blood. In some embodiments, peptides that have cartilage homing properties can have a cartilage signal of >170% by radiographic densitometry measurements. In other embodiments, peptides that are cartilage homers can have a cartilage signal of >200% by radiographic densitometry measurements. In other embodiments, peptides that are more efficient cartilage homers can have a cartilage signal of >300% by radiographic densitometry measurements. In other embodiments, peptides that are more efficient cartilage homers can have a cartilage signal of >400% by radiographic densitometry measurements. In other embodiments, peptides that are strongest cartilage homers of highest interest can have a cartilage signal of >500% by radiographic densitometry measurements. In some embodiments, measurement of the ratio of peptide concentration in blood, muscle, or other tissues relative to the peptide concentration in cartilage can be performed using various methods including measuring the densitometry signal of peptides labeled with radioisotopes (as described above), or by using other assays.

Peptides that selectively home, target, are directed to, migrate to, are retained by, or accumulate in and/or bind to specific regions, tissues, structures or cells of the cartilage can occur after administration of the peptide to a subject. A subject can be a human or a non-human animal.

The peptides disclosed herein can be used as active agents, or conjugated to detection agents such a fluorophores, iodide-containing X-ray contrast agents, lanthanide chelates (e.g., gadolinium for MRI imaging), perfluorocarbons (for ultrasound), or PET tracers (e.g., 18F or 11C) for imaging and tracing the peptide, or conjugated to agents such as anti-inflammatory active agents or other active agents to the joint to treat inflammation or other disease.

The peptides disclosed herein can be used to bind cartilage explants ex vivo. Cartilage explants can be from any subject, such as a human or an animal. Assessment of peptide binding to cartilage explants can be used to screen peptides that may efficiently home to cartilage in vivo In some embodiments, peptides of this disclosure home, target, are directed to, migrate to, are retained by, accumulate in, or bind to specific regions, tissues, structures or cells of the kidneys. For example, in some embodiments, peptides of this disclosure home, target, are directed to, migrate to, are retained by, accumulate in, or bind to the proximal tubules of the kidneys, kidney nephrons, or podocytes. Peptides that selectively home, target, are directed to, migrate to, are retained by, or accumulate in and/or bind to specific regions, tissues, structures or cells of the kidney can occur after administration of the peptide to a subject. A subject can be a human or a non-human animal. The peptides disclosed herein can be used as active agents, or conjugated to detection agents such a fluorophores, iodide-containing X-ray contrast agents, lanthanide chelates (e.g., gadolinium for MRI imaging), perfluorocarbons (for ultrasound), or PET tracers (e.g., 18F or 11C) for imaging and tracing the peptide, or conjugated to agents such as anti-inflammatory agents or other agents to the kidney to treat renal cancer, chronic kidney failure or other kidney disease.

One roadblock in the advancement and wide spread use of peptides as a therapeutic is that peptides can be chemically and physically unstable. During the process of manufacturing of therapeutic peptides essential considerations can include storage conditions, sustained biochemical function, and in vivo delivery. Peptide degradation products can result in the formation of species that alter the safety profile, potency, and immunogenicity of the peptide. These peptide degradation products can form during manufacture and storage, as well as in vivo after delivery to a patient. Furthermore, peptide degradation may limit the shelf-life and increase production cost due to unstable peptides requiring refrigeration or shipment on dry ice. The latter can necessitate continual monitoring and validation of peptides as degradation products could have formed during the manufacturing process. Hence, there is an urgent need for the rationale design and production of therapeutic peptides that have enhanced stability, for example, in the ambient environment, during the process of manufacturing, in storage, and that prevent the likelihood of peptide degradation under a variety of conditions.

In some embodiments, the peptides and peptide-drug conjugates of the present disclosure have stability properties that minimize peptide or peptide-drug conjugate degradation to enable adequate storage. Long term, accelerated, and intermediate storage conditions for the peptides and peptide-drug conjugates of the present disclosure can include long term storage conditions of 25° C.±2° C./60% relative humidity (RH)±5% RH, or 30° C.±2° C./65% RH±5% RH for at least 6 months, at least 12 months, and up to 1 year, up to 2 years, up to 3 years, up to 4 years, or longer than 4 years. In addition, intermediate and short term storage conditions (e.g., during transport, distribution, manufacturing, or handling), or long term storage conditions for certain climates and infrastructures, can include storage conditions of 30° C.±2° C./65% RH±5% RH or 40° C.±2° C./75% RH±5% RH for up to 1 hour, for up to 8 hours, for up to 1 day, for up to 3 days, for up to 1 week, for up to 1 month, for up to 3 months, for up to 6 months or at least 6 months, up to 1 year, up to 2 years, up to 3 years, up to 4 years, or longer than 4 years). Moreover, the peptides and peptide-drug conjugates of the present disclosure can be refrigerated, for example between 5° C.±3° C. for at least 6 months, at least 12 months, and up to 1 year, up to 2 years, up to 3 years, up to 4 years, or longer than 4 years. In addition, intermediate and short term refrigeration conditions (e.g., during transport, distribution, manufacturing, or handling) can include 25° C.±2° C./60% RH±5% RH for up to 1 hour, for up to 8 hours, for up to 1 day, for up to 3 days, for up to 1 week, for up to 1 month, for up to 3 months, for up to 6 months or at least 6 months, and potentially longer (at least 12 months and up to 1 year, up to 2 years, up to 3 years, up to 4 years, or longer than 4 years). Such conditions for storage, whether based on ambient or refrigerated conditions can be adjusted based upon the four zones in the world (e.g., the International Council for Harmonisation of Technical Requirements for Pharmaceuticals for Human Use (ICH) stability Zone I, II, III, or IV) that are distinguished by their characteristic prevalent annual climatic conditions. In addition, formulation components can be principally chosen for their ability to preserve the native conformation and chemical structure of the peptides and peptide-drug conjugates of the present disclosure in storage by preventing denaturation due to hydrophobic interactions and aggregation, as well as by preventing chemical degradation, including truncation, oxidation, deamidation, cleavage, hydrolysis, isomerization, disulfide exchange, racemization, and beta elimination (Cleland, et al., *Crit Rev Ther Drug Carrier Syst* 10(4): 307-377 (1993); Shire et al., *J Pharm Sci* 93(6): 1390-1402 (2004); Wakankar and Borchardt, *J Pharm Sci* 95(11): 2321-2336 (2006)).

In some embodiments, the peptides and peptide-drug conjugates of the present disclosure have incorporated properties that minimize immunogenicity of the peptides and peptide-drug conjugates. Immunogenicity can be a major concern with the development of therapeutic peptides and proteins, and there is an urgent need for the rationale design and production of therapeutic peptides that have reduced immunogenicity and that increase their safety and efficacy. Immunogenicity can occur against a desired peptide sequence or a peptide degradation product. Immunogenicity can occur when a patient develops an immune response to the therapeutic peptide, protein, conjugate, or other drug, such as by producing antibodies that bind to and/or neutralize the therapeutic peptide, protein, conjugate, or other drug. The likelihood of immunogenicity can increase when drugs are administered more than once or chronically. Immunogenicity can reduce patient exposure to the drug, can reduce effectiveness of the drug, and can also result in safety risks for the patient, such as generating an immune response to self-proteins or other adverse responses related to increased immunogenicity to the therapeutic peptide, protein, conjugate, or other drug. Immunogenic responses can vary from patient to patient and also amongst different groups of HLA alleles, as well as over time. As such, minimizing risk of immunogenicity with a therapeutic peptide or protein can be important for developing a drug that can be effectively and safely used for treatment. Various methods exist for assessment of immunogenic potential, which can include in silico methods, in vitro testing, preclinical in vivo testing, and assessment during clinical dosing. Evaluation early in product design and development of the therapeutic peptides and peptide-drug conjugates of the present disclosure in the in vivo milieu in which they function (e.g., in inflammatory environments or at physiologic pH) can reveal susceptibilities to modifications (e.g., aggregation and deamidation) that can result in loss of efficacy or induction of immune responses. Such information can be used to facilitate product engineering to enhance the stability of the product under such in vivo conditions or reduce immunogenicity. Moreover, the therapeutic peptides and peptide-drug conjugates of the present disclosure can be designed to minimize protein aggregation. Strategies to minimize aggregate formation can be used early in drug development, for example, by using an appropriate cell substrate, selecting manufacturing conditions that minimize aggregate formation, employing a robust purification scheme that removes aggregates to the greatest extent possible, and choosing a formulation and container closure system that minimize aggregation during storage.

Additional aspects and advantages of the present disclosure will become apparent to those skilled in this art from the following detailed description, wherein illustrative embodiments of the present disclosure are shown and described. As will be realized, the present disclosure is capable of other and different embodiments, and its several details are capable of modifications in various respects, all without departing from the disclosure. Accordingly, the drawings and description are to be regarded as illustrative in nature, and not as restrictive.

As used herein, the abbreviations for the natural L-enantiomeric amino acids are conventional and are as follows: alanine (A, Ala); arginine (R, Arg); asparagine (N, Asn); aspartic acid (D, Asp); cysteine (C, Cys); glutamic acid (E, Glu); glutamine (Q, Gln); glycine (G, Gly); histidine (H, His); isoleucine (I, Ile); leucine (L, Leu); lysine (K, Lys); methionine (M, Met); phenylalanine (F, Phe); proline (P, Pro); serine (S, Ser); threonine (T, Thr); tryptophan (W, Trp); tyrosine (Y, Tyr); valine (V, Val). Typically, Xaa can indicate any amino acid. In some embodiments, X can be asparagine (N), glutamine (Q), histidine (H), lysine (K), or arginine (R).

Some embodiments of the disclosure contemplate D-amino acid residues of any standard or non-standard amino acid or analogue thereof. When an amino acid sequence is represented as a series of three-letter or one-letter amino acid abbreviations, the left-hand direction is the amino terminal direction and the right-hand direction is the carboxyl terminal direction, in accordance with standard usage and convention.

The present disclosure also provides compositions and methods for the detection and/or treatment of cancers. The compositions described herein comprise peptide conjugates comprising a detectable label, which are suitable for the detection and treatment of various cancers. In certain aspects, the compositions are provided in combination with a pharmaceutically acceptable carrier, which can be administered to a subject by any parenteral route of administration. The compositions described herein give rise to a pharmacokinetic profile when administered intravenously to a human subject. Following administration of the compositions described herein, the conjugates bind selectively to cancer cells. The cancer cells can then be detected, for example, by imaging or other visualization or detection method suitable for detecting the detectable label of the peptide conjugate. In further aspects, the presently described compositions can be used to treat cancer by way of a therapeutic agent, which is attached to the conjugate and which acts on the cancer cells following binding by the peptide portion of the conjugate. These and other aspects are described in detail herein.

The invention will best be understood by reference to the following detailed description of the aspects and embodiments of the invention, taken in conjunction with the accompanying drawings and figures. The discussion below is descriptive, illustrative and exemplary and is not to be taken as limiting the scope defined by any appended claims.

As used in the specification and appended claims, unless specified to the contrary, the following terms have the meaning indicated.

As used herein and in the appended claims, the singular forms "a," "and," and "the" include plural referents unless the context clearly dictates otherwise. Thus, for example, reference to "a compound" includes a plurality of such compounds, reference to "an agent" includes a plurality of such agents, and reference to "the cell" includes reference to one or more cells (or to a plurality of cells) and equivalents thereof known to those skilled in the art, and so forth. When ranges are used herein for physical properties, such as molecular weight, or chemical properties, such as chemical formulae, all combinations and subcombinations of ranges and specific embodiments therein are intended to be included. The term "about" when referring to a number or a numerical range means that the number or numerical range referred to is an approximation within experimental variability (or within statistical experimental error), and thus the number or numerical range may vary between 1% and 15% of the stated number or numerical range. The term "comprising" (and related terms such as "comprise" or "comprises" or "having" or "including") is not intended to exclude that in other certain embodiments, for example, an embodiment of any composition of matter, composition, method, or process, or the like, described herein, may "consist of" or "consist essentially of" the described features.

"Cyano" refers to the —CN radical.
"Nitro" refers to the —NO$_2$ radical.
"Oxa" refers to the —O— radical.
"Oxo" refers to the =O radical.
"Thioxo" refers to the =S radical.
"Imino" refers to the =N—H radical.
"Hydrazino" refers to the =N—NH$_2$ radical.

"Alkyl" refers to a straight or branched hydrocarbon chain radical consisting solely of carbon and hydrogen atoms, containing no unsaturation, having from one to fifteen carbon atoms (e.g., $C_1$-$C_{15}$ alkyl). In certain embodiments, an alkyl comprises one to thirteen carbon atoms (e.g., $C_1$-$C_{13}$ alkyl). In certain embodiments, an alkyl comprises one to eight carbon atoms (e.g., $C_1$-$C_8$ alkyl). In other embodiments, an alkyl comprises five to fifteen carbon atoms (e.g., $C_5$-$C_{15}$ alkyl). In other embodiments, an alkyl comprises five to eight carbon atoms (e.g., $C_5$-$C_8$ alkyl). The alkyl is attached to the rest of the molecule by a single bond, for example, methyl (Me), ethyl (Et), n-propyl, 1-methylethyl (iso-propyl), n-butyl, n-pentyl, 1,1-dimethylethyl (t-butyl), 3-methylhexyl, 2-methylhexyl, and the like. Unless stated otherwise specifically in the specification, an alkyl group is optionally substituted by one or more of the following substituents: halo, cyano, nitro, oxo, thioxo, trimethylsilanyl, —OR$^a$, —SR$^a$, —OC(O)—R$^a$, —N(R$^a$)$_2$, —C(O)R$^a$, —C(O)OR$^a$, —C(O)N(R$^a$)$_2$, —N(R$^a$)C(O)OR$^a$, —N(R$^a$)C(O)R$^a$, —N(R$^a$)S(O)$_t$R$^a$ (where t is 1 or 2), —S(O)$_t$OR$^a$ (where t is 1 or 2) and —S(O)$_t$N(R$^a$)$_2$ (where t is 1 or 2) where each R$^a$ is independently hydrogen, alkyl, fluoroalkyl, carbocyclyl, carbocyclylalkyl, aryl, aralkyl, heterocyclyl, heterocyclylalkyl, heteroaryl or heteroarylalkyl.

"Alkenyl" refers to a straight or branched hydrocarbon chain radical group consisting solely of carbon and hydrogen atoms, containing at least one double bond, and having from two to twelve carbon atoms. In certain embodiments, an alkenyl comprises two to eight carbon atoms. In other embodiments, an alkenyl comprises two to four carbon atoms. The alkenyl is attached to the rest of the molecule by a single bond, for example, ethenyl (i.e., vinyl), prop-1-enyl (i.e., allyl), but-1-enyl, pent-1-enyl, penta-1,4-dienyl, and the like. Unless stated otherwise specifically in the specification, an alkenyl group is optionally substituted by one or more of the following substituents: halo, cyano, nitro, oxo, thioxo, trimethylsilanyl, —OR$^a$, —SR$^a$, —OC(O)—R$^a$, —N(R$^a$)$_2$, —C(O)R$^a$, —C(O)OR$^a$, —C(O)N(R$^a$)$_2$, —N(R$^a$)C(O)OR$^a$, —N(R$^a$)C(O)R$^a$, —N(R$^a$)S(O)$_t$R$^a$ (where t is 1 or 2), —S(O)$_t$OR$^a$ (where t is 1 or 2) and —S(O)$_t$N(R$^a$)$_2$ (where t is 1 or 2) where each R$^a$ is independently hydrogen, alkyl, fluoroalkyl, carbocyclyl, carbocyclylalkyl, aryl, aralkyl, heterocyclyl, heterocyclylalkyl, heteroaryl or heteroarylalkyl.

"Alkynyl" refers to a straight or branched hydrocarbon chain radical group consisting solely of carbon and hydrogen atoms, containing at least one triple bond, having from two to twelve carbon atoms. In certain embodiments, an alkynyl comprises two to eight carbon atoms. In other embodiments, an alkynyl has two to four carbon atoms. The alkynyl is attached to the rest of the molecule by a single bond, for example, ethynyl, propynyl, butynyl, pentynyl, hexynyl, and the like. Unless stated otherwise specifically in the specification, an alkynyl group is optionally substituted by one or more of the following substituents: halo, cyano, nitro, oxo, thioxo, trimethylsilanyl, —OR$^a$, —SR$^a$, —OC(O)—R$^a$, —N(R$^a$)$_2$, —C(O)R$^a$, —C(O)OR$^a$, —C(O)N(R$^a$)$_2$, —N(R$^a$)C(O)OR$^a$, —N(R$^a$)C(O)R$^a$, —N(R$^a$)S(O)$_t$R$^a$ (where t is 1 or 2), —S(O)$_t$OR$^a$ (where t is 1 or 2) and —S(O)$_t$N(R$^a$)$_2$ (where t is 1 or 2) where each R$^a$ is independently hydrogen, alkyl, fluoroalkyl, carbocyclyl, carbocyclylalkyl, aryl, aralkyl, heterocyclyl, heterocyclylalkyl, heteroaryl or heteroarylalkyl.

"Alkylene" or "alkylene chain" refers to a straight or branched divalent hydrocarbon chain linking the rest of the molecule to a radical group, consisting solely of carbon and hydrogen, containing no unsaturation and having from one to twelve carbon atoms, for example, methylene, ethylene, propylene, n-butylene, and the like. The alkylene chain is attached to the rest of the molecule through a single bond and to the radical group through a single bond. The points of attachment of the alkylene chain to the rest of the molecule and to the radical group can be through one carbon in the alkylene chain or through any two carbons within the chain. Unless stated otherwise specifically in the specification, an alkylene chain is optionally substituted by one or more of the following substituents: halo, cyano, nitro, aryl, cycloalkyl, heterocyclyl, heteroaryl, oxo, thioxo, trimethylsilanyl, —OR$^a$, —SR$^a$, —OC(O)—R$^a$, —N(R$^a$)$_2$, —C(O)R$^a$, —C(O)OR$^a$, —C(O)N(R$^a$)$_2$, —N(R$^a$)C(O)OR$^a$, —N(R$^a$)C(O)R$^a$, —N(R$^a$)S(O)$_t$R$^a$ (where t is 1 or 2), —S(O)$_t$OR$^a$ (where t is 1 or 2) and —S(O)$_t$N(R$^a$)$_2$ (where t is 1 or 2) where each R$^a$ is independently hydrogen, alkyl, fluoroalkyl, carbocyclyl, carbocyclylalkyl, aryl, aralkyl, heterocyclyl, heterocyclylalkyl, heteroaryl or heteroarylalkyl.

"Alkenylene" or "alkenylene chain" refers to a straight or branched divalent hydrocarbon chain linking the rest of the molecule to a radical group, consisting solely of carbon and hydrogen, containing at least one double bond and having from two to twelve carbon atoms, for example, ethenylene, propenylene, n-butenylene, and the like. The alkenylene chain is attached to the rest of the molecule through a double bond or a single bond and to the radical group through a double bond or a single bond. The points of attachment of the alkenylene chain to the rest of the molecule and to the radical group can be through one carbon or any two carbons within the chain. Unless stated otherwise specifically in the specification, an alkenylene chain is optionally substituted by one or more of the following substituents: halo, cyano, nitro, aryl, cycloalkyl, heterocyclyl, heteroaryl, oxo, thioxo, trimethylsilanyl, —OR$^a$, —SR$^a$, —OC(O)—R$^a$, —N(R$^a$)$_2$, —C(O)R$^a$, —C(O)OR$^a$, —C(O)N(R$^a$)$_2$, —N(R$^a$)C(O)OR$^a$, —N(R$^a$)C(O)R$^a$, —N(R$^a$)S(O)$_t$R$^a$ (where t is 1 or 2), —S(O)$_t$OR$^a$ (where t is 1 or 2) and —S(O)$_t$N(R$^a$)$_2$ (where t is 1 or 2) where each $R^a$ is independently hydrogen, alkyl, fluoroalkyl, cycloalkyl, cycloalkylalkyl, aryl (optionally substituted with one or more halo groups), aralkyl, heterocyclyl, heterocyclylalkyl, heteroaryl or heteroarylalkyl, and where each of the above substituents is unsubstituted unless otherwise indicated.

"Aryl" refers to a radical derived from an aromatic monocyclic or multicyclic hydrocarbon ring system by removing a hydrogen atom from a ring carbon atom. The aromatic monocyclic or multicyclic hydrocarbon ring system contains only hydrogen and carbon from six to eighteen carbon atoms, where at least one of the rings in the ring system is fully unsaturated, i.e., it contains a cyclic, delocalized (4n+2) π-electron system in accordance with the Hückel theory. Aryl groups include, but are not limited to, groups such as phenyl, fluorenyl, and naphthyl. Unless stated otherwise specifically in the specification, the term "aryl" or the prefix "ar-" (such as in "aralkyl") is meant to include aryl radicals optionally substituted by one or more substituents independently selected from alkyl, alkenyl, alkynyl, halo, fluoroalkyl, cyano, nitro, optionally substituted aryl, optionally substituted aralkyl, optionally substituted aralkenyl, optionally substituted aralkynyl, optionally substituted carbocyclyl, optionally substituted carbocyclylalkyl, optionally substituted heterocyclyl, optionally substituted heterocyclylalkyl, optionally substituted heteroaryl, optionally substituted heteroarylalkyl, —$R^b$—$OR^a$, —$R^b$—$OC(O)$—$R^a$, —$R^b$—$N(R^a)_2$, —$R^b$—$C(O)R^a$, —$R^b$—$C(O)OR^a$, —$R^b$—$C(O)N(R^a)_2$, —$R^b$—$O$—$R^c$—$C(O)N(R^a)_2$, —$R^b$—$N(R^a)C(O)OR^a$, —$R^b$—$N(R^a)C(O)R^a$, —$R^b$—$N(R^a)S(O)_tR^a$ (where t is 1 or 2), —$R^b$—$S(O)_tOR^a$ (where t is 1 or 2) and —$R^b$—$S(O)_tN(R^a)_2$ (where t is 1 or 2), where each $R^a$ is independently hydrogen, alkyl, fluoroalkyl, cycloalkyl, cycloalkylalkyl, aryl (optionally substituted with one or more halo groups), aralkyl, heterocyclyl, heterocyclylalkyl, heteroaryl or heteroarylalkyl, each $R^b$ is independently a direct bond or a straight or branched alkylene or alkenylene chain, and $R^c$ is a straight or branched alkylene or alkenylene chain, and where each of the above substituents is unsubstituted unless otherwise indicated.

"Aralkyl" refers to a radical of the formula —$R^c$-aryl where $R^c$ is an alkylene chain as defined above, for example, benzyl, diphenylmethyl and the like. The alkylene chain part of the aralkyl radical is optionally substituted as described above for an alkylene chain. The aryl part of the aralkyl radical is optionally substituted as described above for an aryl group.

"Aralkenyl" refers to a radical of the formula —$R^d$-aryl where $R^d$ is an alkenylene chain as defined above. The aryl part of the aralkenyl radical is optionally substituted as described above for an aryl group. The alkenylene chain part of the aralkenyl radical is optionally substituted as defined above for an alkenylene group.

"Aralkynyl" refers to a radical of the formula —$R^e$-aryl, where $R^e$ is an alkynylene chain as defined above. The aryl part of the aralkynyl radical is optionally substituted as described above for an aryl group. The alkynylene chain part of the aralkynyl radical is optionally substituted as defined above for an alkynylene chain.

"Carbocyclyl" refers to a stable non-aromatic monocyclic or polycyclic hydrocarbon radical consisting solely of carbon and hydrogen atoms, which may include fused or bridged ring systems, having from three to fifteen carbon atoms. In certain embodiments, a carbocyclyl comprises three to ten carbon atoms. In other embodiments, a carbocyclyl comprises five to seven carbon atoms. The carbocyclyl is attached to the rest of the molecule by a single bond. Carbocyclyl may be saturated, (i.e., containing single C—C bonds only) or unsaturated (i.e., containing one or more double bonds or triple bonds.) A fully saturated carbocyclyl radical is also referred to as "cycloalkyl." Examples of monocyclic cycloalkyls include, e.g., cyclopropyl, cyclobutyl, cyclopentyl, cyclohexyl, cycloheptyl, and cyclooctyl. An unsaturated carbocyclyl is also referred to as "cycloalkenyl." Examples of monocyclic cycloalkenyls include, e.g., cyclopentenyl, cyclohexenyl, cycloheptenyl, and cyclooctenyl. Polycyclic carbocyclyl radicals include, for example, adamantyl, norbornyl (i.e., bicyclo[2.2.1]heptanyl), norbornenyl, decalinyl, 7,7-dimethyl-bicyclo[2.2.1] heptanyl, and the like. Unless otherwise stated specifically in the specification, the term "carbocyclyl" is meant to include carbocyclyl radicals that are optionally substituted by one or more substituents independently selected from alkyl, alkenyl, alkynyl, halo, fluoroalkyl, oxo, thioxo, cyano, nitro, optionally substituted aryl, optionally substituted aralkyl, optionally substituted aralkenyl, optionally substituted aralkynyl, optionally substituted carbocyclyl, optionally substituted carbocyclylalkyl, optionally substituted heterocyclyl, optionally substituted heterocyclylalkyl, optionally substituted heteroaryl, optionally substituted heteroarylalkyl, —$R^b$—$OR^a$, —$R^b$—$SR^a$, —$R^b$—$OC(O)$—$R^a$, —$R^b$—$N(R^a)_2$, —$R^b$—$C(O)R^a$, —$R^b$—$C(O)OR^a$, —$R^b$—$C(O)N(R^a)_2$, —$R^b$—$O$—$R^c$—$C(O)N(R^a)_2$, —$R^b$—$N(R^a)C(O)OR^a$, —$R^b$—$N(R^a)C(O)R^a$, —$R^b$—$N(R^a)S(O)_tR^a$ (where t is 1 or 2), —$R^b$—$S(O)_tOR^a$ (where t is 1 or 2) and —$R^b$—$S(O)_tN(R^a)_2$ (where t is 1 or 2), where each $R^a$ is independently hydrogen, alkyl, fluoroalkyl, cycloalkyl, cycloalkylalkyl, aryl, aralkyl, heterocyclyl, heterocyclylalkyl, heteroaryl or heteroarylalkyl, each $R^b$ is independently a direct bond or a straight or branched alkylene or alkenylene chain, and $R^c$ is a straight or branched alkylene or alkenylene chain, and where each of the above substituents is unsubstituted unless otherwise indicated.

"Carbocyclylalkyl" refers to a radical of the formula —$R^c$-carbocyclyl where $R^c$ is an alkylene chain as defined above. The alkylene chain and the carbocyclyl radical is optionally substituted as defined above.

"Halo" or "halogen" refers to bromo, chloro, fluoro or iodo substituents.

"Fluoroalkyl" refers to an alkyl radical, as defined above, that is substituted by one or more fluoro radicals, as defined above, for example, trifluoromethyl, difluoromethyl, 2,2,2-trifluoroethyl, 1-fluoromethyl-2-fluoroethyl, and the like. The alkyl part of the fluoroalkyl radical is optionally substituted as defined above for an alkyl group.

"Heterocyclyl" refers to a stable 3- to 18-membered non-aromatic ring radical that comprises two to twelve carbon atoms and from one to six heteroatoms selected from nitrogen, oxygen and sulfur. Unless stated otherwise specifically in the specification, the heterocyclyl radical is a monocyclic, bicyclic, tricyclic or tetracyclic ring system, which may include fused or bridged ring systems. The heteroatoms in the heterocyclyl radical may be optionally oxidized. One or more nitrogen atoms, if present, are optionally quaternized. The heterocyclyl radical is partially or fully saturated. The heterocyclyl may be attached to the rest of the molecule through any atom of the ring(s). Examples of such heterocyclyl radicals include, but are not limited to, dioxolanyl, thienyl[1,3]dithianyl, decahydroisoquinolyl, imidazolinyl, imidazolidinyl, isothiazolidinyl, isoxazolidinyl, morpholinyl, octahydroindolyl, octahydroisoindolyl, 2-oxopiperazinyl, 2-oxopiperidinyl, 2-oxopyrrolidinyl, oxazolidinyl, piperidinyl, piperazinyl, 4-piperidonyl, pyrrolidinyl, pyrazolidinyl, quinuclidinyl, thiazolidinyl, tetrahydrofuryl, trithianyl, tetrahydropyranyl, thiomorpholinyl, thiamorpholinyl, 1-oxo-thiomorpholinyl, and 1,1-dioxothiomorpholinyl. Unless stated otherwise specifically in the specification, the term "heterocyclyl" is meant to include heterocyclyl radicals as defined above that are optionally substituted by one or more substituents selected from alkyl, alkenyl, alkynyl, halo, fluoroalkyl, oxo, thioxo, cyano, nitro, optionally substituted aryl, optionally substituted aralkyl, optionally substituted aralkenyl, optionally substituted aralkynyl, optionally substituted carbocyclyl, optionally substituted carbocyclylalkyl, optionally substituted heterocyclyl, optionally substituted heterocyclylalkyl, optionally substituted heteroaryl, optionally substituted heteroarylalkyl, —$R^b$—$OR^a$, —$R^b$—$SR^a$, —$R^b$—OC(O)—$R^a$, —$R^b$—N($R^a$)$_2$, —$R^b$—C(O)$R^a$, —$R^b$—C(O)$OR^a$, —$R^b$—C(O)N($R^a$)$_2$, —$R^b$—O—$R^c$—C(O)N($R^a$)$_2$, —$R^b$—N($R^a$)C(O)$OR^a$, —$R^b$—N($R^a$)C(O)$R^a$, —$R^b$—N($R^a$)S(O)$_t$$R^a$ (where t is 1 or 2), —$R^b$—S(O)$_t$$OR^a$ (where t is 1 or 2) and —$R^b$—S(O)$_t$N($R^a$)$_2$ (where t is 1 or 2), where each $R^a$ is independently hydrogen, alkyl, fluoroalkyl, cycloalkyl, cycloalkylalkyl, aryl, aralkyl, heterocyclyl, heterocyclylalkyl, heteroaryl or heteroarylalkyl, each $R^b$ is independently a direct bond or a straight or branched alkylene or alkenylene chain, and $R^c$ is a straight or branched alkylene or alkenylene chain, and where each of the above substituents is unsubstituted unless otherwise indicated.

"N-heterocyclyl" or "N-attached heterocyclyl" refers to a heterocyclyl radical as defined above containing at least one nitrogen and where the point of attachment of the heterocyclyl radical to the rest of the molecule is through a nitrogen atom in the heterocyclyl radical. An N-heterocyclyl radical is optionally substituted as described above for heterocyclyl radicals. Examples of such N-heterocyclyl radicals include, but are not limited to, 1-morpholinyl, 1-piperidinyl, 1-piperazinyl, 1-pyrrolidinyl, pyrazolidinyl, imidazolinyl, and imidazolidinyl.

"C-heterocyclyl" or "C-attached heterocyclyl" refers to a heterocyclyl radical as defined above containing at least one heteroatom and where the point of attachment of the heterocyclyl radical to the rest of the molecule is through a carbon atom in the heterocyclyl radical. A C-heterocyclyl radical is optionally substituted as described above for heterocyclyl radicals. Examples of such C-heterocyclyl radicals include, but are not limited to, 2-morpholinyl, 2- or 3- or 4-piperidinyl, 2-piperazinyl, 2- or 3-pyrrolidinyl, and the like.

"Heterocyclylalkyl" refers to a radical of the formula —$R^c$-heterocyclyl where $R^c$ is an alkylene chain as defined above. If the heterocyclyl is a nitrogen-containing heterocyclyl, the heterocyclyl is optionally attached to the alkyl radical at the nitrogen atom. The alkylene chain of the heterocyclylalkyl radical is optionally substituted as defined above for an alkylene chain. The heterocyclyl part of the heterocyclylalkyl radical is optionally substituted as defined above for a heterocyclyl group.

"Heteroaryl" refers to a radical derived from a 3- to 18-membered aromatic ring radical that comprises two to seventeen carbon atoms and from one to six heteroatoms selected from nitrogen, oxygen and sulfur. As used herein, the heteroaryl radical may be a monocyclic, bicyclic, tricyclic or tetracyclic ring system, wherein at least one of the rings in the ring system is fully unsaturated, i.e., it contains a cyclic, delocalized (4n+2) π-electron system in accordance with the Hückel theory. Heteroaryl includes fused or bridged ring systems. The heteroatom(s) in the heteroaryl radical is optionally oxidized. One or more nitrogen atoms, if present, are optionally quaternized. The heteroaryl is attached to the rest of the molecule through any atom of the ring(s). Examples of heteroaryls include, but are not limited to, azepinyl, acridinyl, benzimidazolyl, benzindolyl, 1,3-benzodioxolyl, benzofuranyl, benzooxazolyl, benzo[d]thiazolyl, benzothiadiazolyl, benzo[b][1,4]dioxepinyl, benzo[b][1,4]oxazinyl, 1,4-benzodioxanyl, benzonaphthofuranyl, benzoxazolyl, benzodioxolyl, benzodioxinyl, benzopyranyl, benzopyranonyl, benzofuranyl, benzofuranonyl, benzothienyl (benzothiophenyl), benzothieno[3,2-d]pyrimidinyl, benzotriazolyl, benzo[4,6]imidazo[1,2-a]pyridinyl, carbazolyl, cinnolinyl, cyclopenta[d]pyrimidinyl, 6,7-dihydro-5H-cyclopenta[4,5]thieno[2,3-d]pyrimidinyl, 5,6-dihydrobenzo[h]quinazolinyl, 5,6-dihydrobenzo[h]cinnolinyl, 6,7-dihydro-5H-benzo[6,7]cyclohepta[1,2-c]pyridazinyl, dibenzofuranyl, dibenzothiophenyl, furanyl, furanonyl, furo[3,2-c]pyridinyl, 5,6,7,8,9,10-hexahydrocycloocta[d]pyrimidinyl, 5,6,7,8,9,10-hexahydrocycloocta[d]pyridazinyl, 5,6,7,8,9,10-hexahydrocycloocta[d]pyridinyl, isothiazolyl, imidazolyl, indazolyl, indolyl, indazolyl, isoindolyl, indolinyl, isoindolinyl, isoquinolyl, indolizinyl, isoxazolyl, 5,8-methano-5,6,7,8-tetrahydroquinazolinyl, naphthyridinyl, 1,6-naphthyridinonyl, oxadiazolyl, 2-oxoazepinyl, oxazolyl, oxiranyl, 5,6,6a,7,8,9,10,10a-octahydrobenzo[h]quinazolinyl, 1-phenyl-1H-pyrrolyl, phenazinyl, phenothiazinyl, phenoxazinyl, phthalazinyl, pteridinyl, purinyl, pyrrolyl, pyrazolyl, pyrazolo[3,4-d]pyrimidinyl, pyridinyl, pyrido[3,2-d]pyrimidinyl, pyrido[3,4-d]pyrimidinyl, pyrazinyl, pyrimidinyl, pyridazinyl, pyrrolyl, quinazolinyl, quinoxalinyl, quinolinyl, isoquinolinyl, tetrahydroquinolinyl, 5,6,7,8-tetrahydroquinazolinyl, 5,6,7,8-tetrahydrobenzo[4,5]thieno[2,3-d]pyrimidinyl, 6,7,8,9-tetrahydro-5H-cyclohepta[4,5]thieno[2,3-d]pyrimidinyl, 5,6,7,8-tetrahydropyrido[4,5-c]pyridazinyl, thiazolyl, thiadiazolyl, triazolyl, tetrazolyl, triazinyl, thieno[2,3-d]pyrimidinyl, thieno[3,2-d]pyrimidinyl, thieno[2,3-c]pyridinyl, and thiophenyl (i.e. thienyl). Unless stated otherwise specifically in the specification, the term "heteroaryl" is meant to include heteroaryl radicals as defined above which are optionally substituted by one or more substituents selected from alkyl, alkenyl, alkynyl, halo, fluoroalkyl, haloalkenyl, haloalkynyl, oxo, thioxo, cyano, nitro, optionally substituted aryl, optionally substituted aralkyl, optionally substituted aralkenyl, optionally substituted aralkynyl, optionally substituted carbocyclyl, optionally substituted carbocyclylalkyl, optionally substituted heterocyclyl, optionally substituted heterocyclylalkyl, optionally substituted heteroaryl, optionally substituted heteroarylalkyl, —$R^b$—$OR^a$, —$R^b$—$SR^a$, —$R^b$—OC(O)—$R^a$, —$R^b$—N($R^a$)$_2$, —$R^b$—C(O)$R^a$, —$R^b$—C(O)$OR^a$, —$R^b$—C(O)N($R^a$)$_2$, —$R^b$—O—$R^c$—C(O)N($R^a$)$_2$, —$R^b$—N($R^a$)C(O)$OR^a$, —$R^b$—N($R^a$)C(O)$R^a$, —$R^b$—N($R^a$)S(O)$_t$$R^a$ (where t is 1 or 2), —$R^b$—S(O)$_t$$OR^a$ (where t is 1 or 2) and —$R^b$—S(O)$_t$N($R^a$)$_2$ (where t is 1 or 2), where each $R^a$ is independently hydrogen, alkyl, fluoroalkyl, cycloalkyl, cycloalkylalkyl, aryl, aralkyl, heterocyclyl, heterocyclylalkyl, heteroaryl or heteroarylalkyl, each $R^b$ is independently a direct bond or a straight or branched alkylene or alkenylene chain, and $R^c$ is a straight or branched alkylene or alkenylene chain, and where each of the above substituents is unsubstituted unless otherwise indicated.

"N-heteroaryl" refers to a heteroaryl radical as defined above containing at least one nitrogen and where the point of attachment of the heteroaryl radical to the rest of the molecule is through a nitrogen atom in the heteroaryl radical. An N-heteroaryl radical is optionally substituted as described above for heteroaryl radicals.

"C-heteroaryl" refers to a heteroaryl radical as defined above and where the point of attachment of the heteroaryl radical to the rest of the molecule is through a carbon atom in the heteroaryl radical. A C-heteroaryl radical is optionally substituted as described above for heteroaryl radicals.

"Heteroarylalkyl" refers to a radical of the formula —R$^c$-heteroaryl, where R$^c$ is an alkylene chain as defined above. If the heteroaryl is a nitrogen-containing heteroaryl, the heteroaryl is optionally attached to the alkyl radical at the nitrogen atom. The alkylene chain of the heteroarylalkyl radical is optionally substituted as defined above for an alkylene chain. The heteroaryl part of the heteroarylalkyl radical is optionally substituted as defined above for a heteroaryl group.

The compounds, or their pharmaceutically acceptable salts may contain one or more asymmetric centers and may thus give rise to enantiomers, diastereomers, and other stereoisomeric forms that may be defined, in terms of absolute stereochemistry, as (R)- or (S)- or, as (D)- or (L)- for amino acids. When the compounds described herein contain olefinic double bonds or other centers of geometric asymmetry, and unless specified otherwise, it is intended that the compounds include both E (or trans) and Z (cis) geometric isomers. Likewise, all possible isomers, as well as their racemic and optically pure forms, and all tautomeric forms are also intended to be included.

A "stereoisomer" refers to a compound made up of the same atoms bonded by the same bonds but having different three-dimensional structures, which are not interchangeable. It is therefore contemplated that various stereoisomers and mixtures thereof and includes "enantiomers," which refers to two stereoisomers whose molecules are nonsuperimposeable mirror images of one another.

A "tautomer" refers to a proton shift from one atom of a molecule to another atom of the same molecule. The compounds presented herein may exist as tautomers. Tautomers are compounds that are interconvertible by migration of a hydrogen atom, accompanied by a switch of a single bond and adjacent double bond. In solutions where tautomerization is possible, a chemical equilibrium of the tautomers will exist. The exact ratio of the tautomers depends on several factors, including temperature, solvent, and pH. Some examples of tautomeric pairs include:

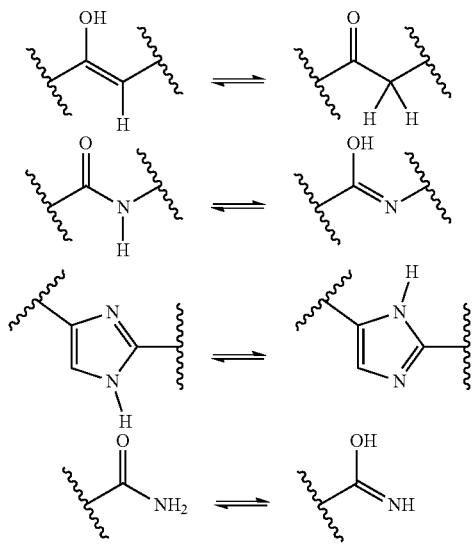

-continued

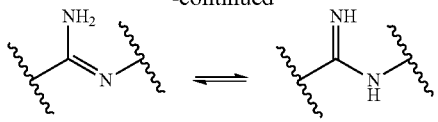

"Optional" or "optionally" means that a subsequently described event or circumstance may or may not occur and that the description includes instances when the event or circumstance occurs and instances in which it does not.

"Pharmaceutically acceptable salt" includes both acid and base addition salts. A pharmaceutically acceptable salt of any one of the alkoxyphenyl-linked amine derivative compounds described herein is intended to encompass any and all pharmaceutically suitable salt forms. Preferred pharmaceutically acceptable salts of the compounds described herein are pharmaceutically acceptable acid addition salts and pharmaceutically acceptable base addition salts.

"Pharmaceutically acceptable acid addition salt" refers to those salts which retain the biological effectiveness and properties of the free bases, which are not biologically or otherwise undesirable, and which are formed with inorganic acids such as hydrochloric acid, hydrobromic acid, sulfuric acid, nitric acid, phosphoric acid, hydroiodic acid, hydrofluoric acid, phosphorous acid, and the like. Also included are salts that are formed with organic acids such as aliphatic mono- and dicarboxylic acids, phenyl-substituted alkanoic acids, hydroxy alkanoic acids, alkanedioic acids, aromatic acids, aliphatic and. aromatic sulfonic acids, etc. and include, for example, acetic acid, trifluoroacetic acid, propionic acid, glycolic acid, pyruvic acid, oxalic acid, maleic acid, malonic acid, succinic acid, fumaric acid, tartaric acid, citric acid, benzoic acid, cinnamic acid, mandelic acid, methanesulfonic acid, ethanesulfonic acid, p-toluenesulfonic acid, salicylic acid, and the like. Exemplary salts thus include sulfates, pyrosulfates, bisulfates, sulfites, bisulfites, nitrates, phosphates, monohydrogenphosphates, dihydrogenphosphates, metaphosphates, pyrophosphates, chlorides, bromides, iodides, acetates, trifluoroacetates, propionates, caprylates, isobutyrates, oxalates, malonates, succinate suberates, sebacates, fumarates, maleates, mandelates, benzoates, chlorobenzoates, methylbenzoates, dinitrobenzoates, phthalates, benzenesulfonates, toluenesulfonates, phenylacetates, citrates, lactates, malates, tartrates, methanesulfonates, and the like. Also contemplated are salts of amino acids, such as arginates, gluconates, and galacturonates (see, for example, Berge S. M. et al., "Pharmaceutical Salts," *Journal of Pharmaceutical Science*, 66:1-19 (1997), which is hereby incorporated by reference in its entirety). Acid addition salts of basic compounds may be prepared by contacting the free base forms with a sufficient amount of the desired acid to produce the salt according to methods and techniques with which a skilled artisan is familiar.

"Pharmaceutically acceptable base addition salt" refers to those salts that retain the biological effectiveness and properties of the free acids, which are not biologically or otherwise undesirable. These salts are prepared from addition of an inorganic base or an organic base to the free acid. Pharmaceutically acceptable base addition salts may be formed with metals or amines, such as alkali and alkaline earth metals or organic amines. Salts derived from inorganic bases include, but are not limited to, sodium, potassium, lithium, ammonium, calcium, magnesium, iron, zinc, copper, manganese, aluminum salts and the like. Salts derived from organic bases include, but are not limited to, salts of primary, secondary, and tertiary amines, substituted amines including naturally occurring substituted amines, cyclic amines and basic ion exchange resins, for example, isopropylamine, trimethylamine, diethylamine, triethylamine, tripropylamine, ethanolamine, diethanolamine, 2-dimethylaminoethanol, 2-diethylaminoethanol, dicyclohexylamine, lysine, arginine, histidine, caffeine, procaine, N,N-dibenzylethylenediamine, chloroprocaine, hydrabamine, choline, betaine, ethylenediamine, ethylenedianiline, N-methylglucamine, glucosamine, methylglucamine, theobromine, purines, piperazine, piperidine, N-ethylpiperidine, polyamine resins and the like. See Berge et al., supra.

As used herein, "treatment" or "treating," or "palliating" or "ameliorating" are used interchangeably herein. These terms refers to an approach for obtaining beneficial or desired results including but not limited to therapeutic benefit and/or a prophylactic benefit. By "therapeutic benefit" is meant eradication or amelioration of the underlying disorder being treated. Also, a therapeutic benefit is achieved with the eradication or amelioration of one or more of the physiological symptoms associated with the underlying disorder such that an improvement is observed in the patient, notwithstanding that the patient may still be afflicted with the underlying disorder. For prophylactic benefit, the compositions may be administered to a patient at risk of developing a particular disease, or to a patient reporting one or more of the physiological symptoms of a disease, even though a diagnosis of this disease may not have been made.

"Prodrug" is meant to indicate a compound that may be converted under physiological conditions or by solvolysis to a biologically active compound described herein. Thus, the term "prodrug" refers to a precursor of a biologically active compound that is pharmaceutically acceptable. A prodrug may be inactive when administered to a subject, but is converted in vivo to an active compound, for example, by hydrolysis. The prodrug compound often offers advantages of solubility, tissue compatibility or delayed release in a mammalian organism (see, e.g., Bundgard, H., Design of Prodrugs (1985), pp. 7-9, 21-24 (Elsevier, Amsterdam).

A discussion of prodrugs is provided in Higuchi, T., et al., "Pro-drugs as Novel Delivery Systems," A.C.S. Symposium Series, Vol. 14, and in Bioreversible Carriers in Drug Design, ed. Edward B. Roche, American Pharmaceutical Association and Pergamon Press, 1987, both of which are incorporated in full by reference herein.

The term "prodrug" is also meant to include any covalently bonded carriers, which release the active compound in vivo when such prodrug is administered to a mammalian subject. Prodrugs of an active compound, as described herein, may be prepared by modifying functional groups present in the active compound in such a way that the modifications are cleaved, either in routine manipulation or in vivo, to the parent active compound. Prodrugs include compounds wherein a hydroxy, amino or mercapto group is bonded to any group that, when the prodrug of the active compound is administered to a mammalian subject, cleaves to form a free hydroxy, free amino or free mercapto group, respectively. Examples of prodrugs include, but are not limited to, acetate, formate and benzoate derivatives of alcohol or amine functional groups in the active compounds and the like.

Peptides

The cystine-dense peptides herein can bind targets with antibody-like affinity. The cystine-dense peptides can modulate the activity of a plurality of cartilage regions, tissues, structures or cells. For example, in some embodiments, the cystine-dense peptide conjugated to a bone-modifying drug homes to the cartilage of a diseased joint and releases the drug, creating a higher local concentration of drug in an area of eroded or damaged bone than would be achieved without the cartilage targeting function of the peptide. The cystine-dense peptide can be conjugated to a drug that can affect nearby tissues or cells such as the ligaments, muscle, tendons, bursa, connective tissue, blood vessels, peripheral nerves, osteoclasts, osteoblasts, fibroblasts, synoviocytes, monocytes/macrophages, lymphocytes, plasma cells, adipocytes, endothelial cells, neurons, ligaments, muscle, tendons, and bursa. The cystine-dense peptide conjugated to a drug can bind to, home to, migrate to, accumulate in, be retained by, or be directed to cartilage and its components, including chondrocytes, extracellular matrix, collagen of any type, hyaluranon, aggrecan (also known as cartilage-specific proteoglycan core protein (CSPCP)), proteoglycans, glycoasminoglycans, glycoproteins, decorin, biclycan, fibromodulin, or other components of the extracellular matrix and the joint, or to other nearby components such as those described herein in joints and cartilaginous tissues as listed above. Some of the cartilage regions, tissues, and structures that peptides and peptide-drug conjugates can target to treat a cartilage-associated disorder include: (a) elastic cartilage; (b) hyaline cartilage, such as articular cartilage and physeal cartilage; (c) fibrocartilage; and (d) any cells or cell types in (a)-(c) above. Some of the areas where the peptide and peptide-drug conjugates can target to treat a cartilage-associated disorder include: cartilage includes joints such as knees, hips, or digits, nasal cartilage, spinal cartilage, tracheal cartilage, and rib cartilage. In various aspects, cartilage components include aggrecan and type II collagen. Additionally, in some embodiments, cystine-dense peptides can penetrate into cells. In other embodiments, cystine-dense peptides do not enter cells. In other embodiments, cystine-dense peptides exhibit more rapid clearance and cellular uptake compared to other types of molecules.

The peptides of the present disclosure can comprise cysteine amino acid residues. In some cases, the peptide has at least 4 cysteine amino acid residues. In some cases, the peptide has at least 6 cysteine amino acid residues. In other cases, the peptide has at least 8 cysteine amino acid residues, at least 10 cysteine amino acid residues, at least 12 cysteine amino acid residues, at least 14 cysteine amino acid residues or at least 16 cysteine amino acid residues.

A cystine-dense peptide can comprise disulfide bridges. A cystine-dense can be a peptide wherein 5% or more of the residues are cysteines forming intramolecular disulfide bonds as cystines. A disulfide-linked peptide can be a drug scaffold. In some embodiments, the disulfide bridges form an inhibitor knot. A disulfide bridge can be formed between cysteine residues, for example, between cysteines 1 and 4, 2 and 5, or, 3 and 6. In some cases, one disulfide bridge passes through a loop formed by the other two disulfide bridges, for example, to form the inhibitor knot. In other cases, the disulfide bridges can be formed between any two cysteine residues.

The present disclosure further includes peptide scaffolds that, e.g., can be used as a starting point for generating additional peptides that can target and home to cartilage. In some embodiments, these scaffolds can be derived from a variety of cystine-dense peptides. In certain embodiments, cystine-dense peptides are assembled into a complex tertiary structure that is characterized by a number of intramolecular disulfide crosslinks, and optionally contain beta strands and other secondary structures such as an alpha helix. For example, cystine-dense peptides include, in some embodiments, small disulfide-rich proteins characterized by a disulfide through disulfide knot. This knot can be, e.g., obtained when one disulfide bridge crosses the macrocycle formed by two other disulfides and the interconnecting backbone. In some embodiments, the cystine-dense peptides can include growth factor cysteine knots or inhibitor cysteine knots. Other possible peptide structures can include peptide having two parallel helices linked by two disulfide bridges without β-sheets (e.g., hefutoxin).

A cystine-dense peptide can comprise at least one amino acid residue in an L configuration. A cystine-dense peptide can comprise at least one amino acid residue in a D configuration. In some embodiments, a cystine-dense peptide is 15-40 amino acid residues long. In other embodiments, a cystine-dense peptide is 11-57 amino acid residues long. In further embodiments, a cystine-dense peptide is at least 20 amino acid residues long.

In some embodiments, the peptides are members of the pfam00451:toxin_2 family. The pfam00451:toxin_2 structural class family can include a peptide of any one of SEQ ID NO: 978-SEQ ID NO: 1024. A cartilage homing peptide of this disclosure can be a variant of any peptide members of the pfam00451:toxin_2 family. In some embodiments, an exemplary cartilage homing peptide of this disclosure that is a variant of the pfam00451:toxin_2 structural class family is a peptide of SEQ ID NO: 511. In other embodiments, an exemplary cartilage homing peptide of this disclosure that is a variant of the pfam00451:toxin_2 structural class family is a peptide of SEQ ID NO: 592. In other embodiments, the variant peptides are at least 30% identical to a peptide of the structural class pfam00451:toxin_2 family. In some embodiments, the variant peptides are 30%, 40%, 50%, 60%, 80%, 90% or 95% identical to a peptide of the structural class pfam00451:toxin_2 family. In some embodiments, the variant peptides are at least 30%, at least 40%, at least 50%, at least 60%, at least 80%, at least 90% or at least 95% identical to a peptide of the structural class pfam00451:toxin_2 family.

In some embodiments, cartilage homing peptides are family members the sequences GSXVXXXXVKCXG-SKQCXXPCKRXXGXRXGKCINKKXCKCYXXX (SEQ ID NO: 493) or XVXXXXVKCXGSKQCXXPCK-RXXGXRXGKCINKKXCKCYXXX (SEQ ID NO: 767) wherein X can be any amino acid or amino acid analogue or null, in which these sequences are based on the most common elements found in the following sequences: GSGVPINVKCRGSRDCLDPCKKA-GMRFGKCINSK-CHCTP-- (SEQ ID NO: 511), GS-VRIPVSCK-HSGQCLKPCKDA-GMRFGKCMNGK-CDCTPK- (SEQ ID NO: 510), GSQVQTNVKCQGGS-CASVCR-REIGVAAGKCINGK-CVCYRN- (SEQ ID NO: 514), GS-----ISCTGSKQCYDPCKRKTGCPNAKCMNKS-CK-CYGCG (SEQ ID NO: 513), GSEV---IRCSG-SKQCYGPCKQQTGCTNSKCMNKV-CKCYGCG (SEQ ID NO: 515), GSAVCVYRT------CDKDCKRR-GYRSGK-CINNA-CKCYPYG (SEQ ID NO: 512), GS----GIVC--- KVCKIICGMQ-GKKVNICKAPIKCKCKKG- (SEQ ID NO: 508), and GSQIYTSKECNGSSECYSHCE-GITGKRSGKCINKK-CYCYR-- (SEQ ID NO: 517), where the following residues may be independently interchanged in the sequences: K and R; M, I, L, and V; G and A; S and T; Q and N; and X can independently be any number of any amino acid or no amino acid. The N-terminal GS sequence can be included or excluded between the peptides of the present disclosure.

In some embodiments, cartilage homing peptides are family members of the sequences GSXVXIXVKCXGSXQCLXPCKXAXGXRXGKC MNGKCXCXPXX (SEQ ID NO: 505) or XVXIXVKCXGSXQCLXPCKXAXGXRXGKC MNGKCXCXPXX (SEQ ID NO: 779), wherein X can be any amino acid or amino acid analogue or null, in which these sequences are based on the most common elements found in the following sequences: -VRIPVSCK-HSGQCLKPCKDA-GMRFGKCMNGKCDCTPK- (SEQ ID NO: 800), GVPINVKCRGSRDCLDPCKKA-GMRFGKCINSKCHCTP-- (SEQ ID NO: 801), ---EVIRCSGSKQCYGPCKQQTGCTNSKCMNKVCK-CYGCG (SEQ ID NO: 805), GVIINVKCKIS-RQCLEPCKKA-GMRFGKCMNGKCHCTPK- (SEQ ID NO: 817), GVPTDVKCRGSPQCIQPCKDA-GMRFGKCMNGKCHCTPK- (SEQ ID NO: 821), GVP-INVSCTGSPQCIKPCKDA-GMRFGKCMNRKCHCTPK- (SEQ ID NO: 822), -VGINVKCKHSGQCLKPCKDA-GMRFGKCINGKCDCTPK- (SEQ ID NO: 824), GVP-INVRCRGSRDCLDPCRRA-GMRFGRCINSRCHCTP-- (SEQ ID NO: 882), QKILSNRCNNSSECIPH-CIRIFGTRAAKCINRKCYCYP-- (SEQ ID NO: 958), -VF-INVKCRGSPECLPKCKEAIGKSAGKCMNGKCKCYP-- (SEQ ID NO: 967), -VPTDVKCRGSPQCIQPCKDA-GMRFGKCMNGKCHCTP-- (SEQ ID NO: 970), --AEIIRCSGTRECYAPCQKLTGCLNAKCMNKACK-CYGCV (SEQ ID NO: 1027), -RPTDIKCSASYQCFPVCKSRFGKTN-GRCVNGLCDCF--- (SEQ ID NO: 1028), -QFTDVKCTG-SKQCWPVCKQMFGKPNGKCMNGKCRCYS-- (SEQ ID NO: 1029), -VGINVKCKHSRQCLKPCKDA-GMRFGKCTNGKCHCTPK- (SEQ ID NO: 1030), -VVIGQRCYRSPDCYSACKKLVGKATGKCTN-GRCDC---- (SEQ ID NO: 1031), --NFKVEG-ACSKPCRKYCIDK-GARNGKCINGRCHCYY-- (SEQ ID NO: 1032), and QIDTNVKCSGSSKCVKICIDRYNTR-GAKCINGRCTCYP-- (SEQ ID NO: 1033).

In some embodiments, the cartilage homing peptides are family members of the sequences GSXVXIXVRCXGSXQCLXPCRXAXGXRXGRCMN-GRCXCXPXX (SEQ ID NO: 506) or XVXIXVRCXGSXQCLXPCRXAXGXRXGRCMN-GRCXCXPXX (SEQ ID NO: 780) wherein X can be any amino acid or amino acid analogue or null, in which these sequences are based on the most common elements found in the following sequences and with K interchanged with R: SEQ ID NO: 800, SEQ ID NO: 801, SEQ ID NO: 805, SEQ ID NO: 817, SEQ ID NO: 821, SEQ ID NO: 822, SEQ ID NO: 824, SEQ ID NO: 882, SEQ ID NO: 967, SEQ ID NO: 970, or SEQ ID NO: 1027-SEQ ID NO: 1033.

In some embodiments, a peptide comprises the sequence GSGVPIXIVRCRGSRDCX$^2$X$^3$PCRRAGX$^4$RFGRCIX$^5$X$^6$RCX$^7$CX$^8$P (SEQ ID NO: 507) or GVPIXIVRCRGSRDCX$^2$X$^3$PCRRAGX$^4$RFGRCIX$^5$X$^6$RCX$^7$CX$^8$P (SEQ ID NO: 781), where the following residues where X$^1$ is selected from N, S, or G, wherein X$^2$ is selected from L or Y, wherein X$^3$ is selected from D or E, wherein X$^4$ is selected from M or T, wherein X$^5$ is selected from N, Q, A, S, T, or L, wherein X$^6$ is selected from S, G, or R, wherein X$^7$ is selected from H or Y, and wherein X$^8$ is selected from T or Y. In some embodiments, zero or one or more of the R residues in SEQ ID NO: 507 or SEQ ID NO: 781 can be replaced with K residues. In some embodiments, zero or one or more of the R residues in SEQ ID NO: 507 or SEQ ID NO: 781 can be replaced with A residues. In other embodiments, zero or one or more R residues in SEQ ID NO: 507 or SEQ ID NO: 781 can each be replaced with either a K or an A residue in any combination. In other embodiments, peptides are family members of the sequence GSXXXGCVXXXXKCRPGXKXCCXPXKRCS RRFGXXXXKKCKXXXXXX (SEQ ID NO: 494) or XXXGCVXXXXKCRPGXKXCCXPXKRCSRRF GXXXXKKCKXXXXXX (SEQ ID NO: 768), in which the sequence is based on the most common elements found in the following sequences: GS---ACKGVFDACTPGK-NECC-PNRVCSDK-H----KWCKWKL--- (SEQ ID NO: 516), GS---GCLEFWWKCNPNDDKC-CRPKLKCSKLF-----KLCNFSFG-- (SEQ ID NO: 518), GSSEKDCIKHLQRCR-ENKDCC--SKKCSRR-GTN-PEKRCR------ (SEQ ID NO: 509), and GS---GCFGY--KCDYY-KGCCSGYV-CSPTW-----KWCVRPGPGR (SEQ ID NO: 520), where the following residues may be independently interchanged in the sequences: K and R; M, I, L, and V; G and A; S and T; Q and N; and X can independently be any number of any amino acid or no amino acid. The N-terminal GS sequence can be included or excluded between the peptides of the present disclosure.

In some embodiments, a peptide comprises the sequence GSGVX$^1$IX$^2$X$^3$KCX$^4$GSKQCX$^5$DPCKX$^6$X$^7$X$^8$GX$^9$RX$^{10}$GKCX$^{11}$NKKCKCX$^{12}$X$^{13}$X$^{14}$X$^{15}$ (SEQ ID NO: 485) or GVX$^1$IX$^2$X$^3$KCX$^4$GSKQCX$^5$DPCKX$^6$X$^7$X$^8$GX$^9$RX$^{10}$GKCX$^{11}$NKKCKCX$^{12}$X$^{13}$X$^{14}$X$^{15}$ (SEQ ID NO: 759), wherein X$^1$, X$^2$, X$^3$, X$^4$, X$^5$, X$^6$, X$^7$, X$^8$, X$^9$, X$^{10}$, X$^{11}$, X$^{12}$, X$^{13}$, X$^{14}$ and X$^{15}$ are each individually any amino acid or amino acid analogue or null. In some cases, the peptide comprises the sequence GSGVX$^1$IX$^2$X$^3$KCX$^4$GSKQCX$^5$DPCKX$^6$X$^7$X$^8$GX$^9$RX$^{10}$GKCX$^{11}$NKKCKCX$^{12}$X$^{13}$X$^{14}$X$^{15}$ (SEQ ID NO: 486) or GVX$^1$IX$^2$X$^3$KCX$^4$GSKQCX$^5$DPCKX$^6$X$^7$X$^8$GX$^9$RX$^{10}$GKCX$^{11}$NKKCKCX$^{12}$X$^{13}$X$^{14}$X$^{15}$ (SEQ ID NO: 760), where X$^1$ is selected from P or R, wherein X$^2$ is selected from P or N, wherein X$^3$ is selected from V or I, wherein X$^4$ is selected from S, T, R or K, wherein X$^5$ is selected from Y or L, wherein X$^6$ is selected from Q, R or K, wherein X$^7$ is selected from A, K or R, wherein X$^8$ is selected from T or A, wherein X$^9$ is selected from C or M, wherein X$^{10}$ is selected from F or N, wherein X$^{11}$ is selected from M or I, wherein X$^{12}$ is selected from Y or T, wherein X$^{13}$ is selected from G or P, wherein X$^{14}$ is selected from C or null, and wherein X$^{15}$ is selected from G or null.

In some embodiments, a peptide comprises the sequence GSX$^1$X$^2$X$^3$X$^4$IX$^5$CX$^6$GSKQCYX$^7$PCKX$^8$X$^9$TGCX$^{10}$X$^{11}$X$^{12}$KCX$^{13}$X$^{14}$KX$^{15}$CKCYGCG (SEQ ID NO: 487) or X$^1$X$^2$X$^3$X$^4$IX$^5$CX$^6$GSKQCYX$^7$PCKX$^8$X$^9$TGCX$^{10}$X$^{11}$X$^{12}$KCX$^{13}$X$^{14}$KX$^{15}$CKCYGCG (SEQ ID NO: 761), wherein X$^1$, X$^2$, X$^3$, X$^4$, X$^5$, X$^6$, X$^7$, X$^8$, X$^9$, X$^{10}$, X$^{11}$, X$^{12}$, X$^{13}$, X$^{14}$, and X$^{15}$ are each individually any amino acid or amino acid analogue or null. In some cases, the peptide comprises the sequence GSX$^1$X$^2$X$^3$X$^4$IX$^5$CX$^6$GSKQCYX$^7$PCKX$^8$X$^9$TGCX$^{10}$X$^{11}$X$^{12}$KCX$^{13}$X$^{14}$KX$^{15}$CKCYGCG (SEQ ID NO: 488) or X$^1$X$^2$X$^3$X$^4$IX$^5$CX$^6$GSKQCYX$^7$PCKX$^8$X$^9$TGCX$^{10}$X$^{11}$X$^{12}$KCX$^{13}$X$^{14}$KX$^{15}$CKCYGCG (SEQ ID NO: 762), where X$^1$ is selected from G or null, wherein X$^2$ is selected from S or null, wherein X$^3$ is selected from E, G or null, wherein X$^4$ is selected from V, S, or null, wherein X$^5$ is selected from R or S, wherein X$^6$ is selected from S or T, wherein X$^7$ is selected from G or D, wherein X$^8$ is selected from Q or R, wherein X$^9$ is selected from Q or K, wherein X$^{10}$ is selected from T or P, wherein X$^{11}$ is selected from N or Q, wherein X$^{12}$ is selected from S or A, wherein X$^{13}$ is selected from M or L, wherein X$^{14}$ is selected from N or Q, and wherein X$^{15}$ is selected from V or S.

In some embodiments, a peptide comprises the sequence GSX$^1$X$^2$X$^3$VX$^4$IX$^5$VX$^6$CX$^7$X$^8$SX$^9$X$^{10}$CLX$^{11}$PCKX$^{12}$AGMRFGKCX$^{13}$NX$^{14}$KCX$^{15}$CTPX$^{16}$ (SEQ ID NO: 489) or X$^1$X$^2$X$^3$VX$^4$IX$^5$VX$^6$CX$^7$X$^8$SX$^9$X$^{10}$CLX$^{11}$PCKX$^{12}$AGMRFGKCX$^{13}$NX$^{14}$KCX$^{15}$CTPX$^{16}$ (SEQ ID NO: 763), wherein X$^1$, X$^2$, X$^3$, X$^4$, X$^5$, X$^6$, X$^7$, X$^8$, X$^9$, X$^{10}$, X$^{11}$, X$^{12}$, X$^{13}$, X$^{14}$, X$^{15}$, X$^{16}$ are each individually any amino acid or amino acid analogue or null. In some cases, the peptide comprises the sequence GSX$^1$X$^2$X$^3$VX$^4$IX$^5$VX$^6$CX$^7$X$^8$SX$^9$X$^{10}$CLX$^{11}$PCKX$^{12}$AGMRFGKCX$^{13}$NX$^{14}$KCX$^{15}$CTPX$^{16}$ (SEQ ID NO: 490) or X$^1$X$^2$X$^3$VX$^4$IX$^5$VX$^6$CX$^7$X$^8$SX$^9$X$^{10}$CLX$^{11}$PCKX$^{12}$AGMRFGKCX$^{13}$NX$^{14}$KCX$^{15}$CTPX$^{16}$ (SEQ ID NO: 764), where X$^1$ is selected from G or null, wherein X$^2$ is selected from G, S or null, wherein X$^3$ is selected from G, S or null, wherein X$^4$ is selected from P or R, wherein X$^5$ is selected from N or P, wherein X$^6$ is selected from K or S, wherein X$^7$ is selected from R or K, wherein X$^8$ is selected from G or H, wherein X$^9$ is selected from R or G, wherein X$^{10}$ is selected from D or Q, wherein X$^{11}$ is selected from D or K, wherein X$^{12}$ is selected from K or D, wherein X$^{13}$ is selected from I or M, wherein X$^{14}$ is selected from S or G, wherein X$^{15}$ is selected from H or D, and wherein X$^{16}$ is selected from K or null.

In some embodiments, a peptide comprises the sequence GSXVXVKCXGSKQCXPCKRXGXRXGKCINKKXCK-CYX (SEQ ID NO: 491) or GSXGCVXKCRPGXKXCCXPXKRCSRRFGXKKCKX (SEQ ID NO: 492), wherein each letter is each individually any amino acid or amino acid analogue and where X is no amino acid or a 1-10 amino acid long peptide fragment wherein each amino acid within such peptide fragment can in each case be any amino acid or amino acid analogue. In some embodiments, a peptide comprises the sequence XVXVKCXGSKQCXPCKRXGXRXGKCINKKXCK-CYX (SEQ ID NO: 765) or XGCVXKCRPGXKXCCXPXKRCSRRFGXKKCKX (SEQ ID NO: 766), wherein each letter is each individually any amino acid or amino acid analogue and where X is no amino acid or a 1-10 amino acid long peptide fragment wherein each amino acid within such peptide fragment can in each case be any amino acid or amino acid analogue.

In some embodiments, a peptide comprises the sequence GSGVX$^1$IX$^2$X$^3$RCX$^4$GSRQCX$^5$DPCRX$^6$X$^7$X$^8$GX$^9$RX$^{10}$GRCX$^{11}$NRRCRCX$^{12}$X$^{13}$X$^{14}$X$^{15}$ (SEQ ID NO: 495) or GVX$^1$IX$^2$X$^3$RCX$^4$GSRQCX$^5$DPCRX$^6$X$^7$X$^8$GX$^9$RX$^{10}$GRCX$^{11}$NRRCRCX$^{12}$X$^{13}$X$^{14}$X$^{15}$ (SEQ ID NO: 769), wherein X$^1$, X$^2$, X$^3$, X$^4$, X$^5$, X$^6$, X$^7$, X$^8$, X$^9$, X$^{10}$, X$^{11}$, X$^{12}$, X$^{13}$, X$^{14}$, and X$^{15}$ are each individually any amino acid or amino acid analogue or null. In some cases, the peptide comprises the sequence GSGVX$^1$IX$^2$X$^3$RCX$^4$GSRQCX$^5$DPCRX$^6$X$^7$X$^8$GX$^9$RX$^{10}$GRCX$^{11}$NRRCRCX$^{12}$X$^{13}$X$^{14}$X$^{15}$ (SEQ ID NO: 496) or GVX$^1$IX$^2$X$^3$RCX$^4$GSRQCX$^5$DPCRX$^6$X$^7$X$^8$GX$^9$RX$^{10}$GRCX$^{11}$NRRCRCX$^{12}$X$^{13}$X$^{14}$X$^{15}$ (SEQ ID NO: 770), where X$^1$ is selected from P or R, wherein X$^2$ is selected from P or N, wherein X$^3$ is selected from V or I, wherein X$^4$ is selected from S, T, R or K, wherein X$^5$ is selected from Y or L, wherein X$^6$ is selected from Q, R or K, wherein X$^7$ is selected from A, K or R, wherein X$^8$ is selected from T or A, wherein X$^9$ is selected from C or M, wherein X$^{10}$ is selected from F or N, wherein X$^{11}$ is selected from M or I, wherein X$^{12}$ is selected from Y or T, wherein X$^{13}$ is selected from G or P, wherein X$^{14}$ is selected from C or null, and wherein X$^{15}$ is selected from G or null.

In some embodiments, a peptide comprises the sequence GSX$^1$X$^2$X$^3$X$^4$IX$^5$CX$^6$GSRQCYX$^7$PCRX$^8$X$^9$TGCX$^{10}$X$^{11}$X$^{12}$RCX$^{13}$X$^{14}$RX$^{15}$CRCYGCG (SEQ ID NO: 497) or X$^1$X$^2$X$^3$X$^4$IX$^5$CX$^6$GSRQCYX$^7$PCRX$^8$X$^9$TGCX$^{10}$ $X^{11}X^{12}RCX^{13}X^{14}RX^{15}CRCYGCG$ (SEQ ID NO: 771), wherein $X^1$, $X^2$, $X^3$, $X^4$, $X^5$, $X^6$, $X^7$, $X^1$, $X^9$, $X^{10}$, $X^{11}$, $X^{12}$, $X^{13}$, $X^{14}$, and $X^{15}$ are each individually any amino acid or amino acid analogue or null. In some cases, the peptide comprises the sequence $GSX^1X^2X^3X^4IX^5CX^6GSRQCYX^7PCRX^8X^9TGCX^{10}$ $X^{11}X^{12}RCX^{13}X^{14}RX^{15}CRCYGCG$, (SEQ ID NO: 498) or $X^1X^2X^3X^4IX^5CX^6GSRQCYX^7PCRX^8X^9TGCX^{10}X^{11}$ $X^{12}RCX^{13}X^{14}RX^{15}CRCYGCG$ (SEQ ID NO: 772), where $X^1$ is selected from G or null, wherein $X^2$ is selected from S or null, wherein $X^3$ is selected from E, G or null, wherein $X^4$ is selected from V, S, or null, wherein $X^5$ is selected from R or S, wherein $X^6$ is selected from S or T, wherein $X^7$ is selected from G or D, wherein $X^8$ is selected from Q or R, wherein $X^9$ is selected from Q, R, or K, wherein $X^{10}$ is selected from T or P, wherein $X^{11}$ is selected from N or Q, wherein $X^{12}$ is selected from S or A, wherein $X^{13}$ is selected from M or L, wherein $X^{14}$ is selected from N or Q, and wherein $X^{15}$ is selected from V or S.

In some embodiments, a peptide comprises the sequence $GSX^1X^2X^3VX^4IX^5VX^6CX^7X^8SX^9X^{10}CLX^{11}$ $PCRX^{12}AGMRFGRCX^{13}NX^{14}RCX^{15}CTPX^{16}$ (SEQ ID NO: 499) or $X^1X^2X^3VX^4IX^5VX^6CX^7X^8SX^9X^{10}CLX^{11}$ $PCRX^{12}AGMRFGRCX^{13}NX^{14}RCX^{15}CTPX^{16}$ (SEQ ID NO: 773), wherein $X^1$, $X^2$, $X^3$, $X^4$, $X^5$, $X^6$, $X^7$, $X^8$, $X^9$, $X^{10}$, $X^{11}$, $X^{12}$, $X^{13}$, $X^{14}$, $X^{15}$, $X^{16}$ are each individually any amino acid or amino acid analogue or null. In some cases, the peptide comprises the sequence $GSX^1X^2X^3VX^4IX^5VX^6CX^7X^8SX^9X^{10}CLX^{11}$ $PCRX^{12}AGMRFGRCX^{13}NX^{14}RCX^{15}CTPX^{16}$ (SEQ ID NO: 500) or $X^1X^2X^3VX^4IX^5VX^6CX^7X^8SX^9X^{10}CLX^{11}$ $PCRX^{12}AGMRFGRCX^{13}NX^{14}RCX^{15}CTPX^{16}$ (SEQ ID NO: 774), where $X^1$ is selected from G or null, wherein $X^2$ is selected from G, S or null, wherein $X^3$ is selected from G, S or null, wherein $X^4$ is selected from P or R, wherein $X^5$ is selected from N or P, wherein $X^6$ is selected from R, K or S, wherein $X^7$ is selected from R or K, wherein $X^8$ is selected from G or H, wherein $X^9$ is selected from R or G, wherein $X^{10}$ is selected from D or Q, wherein $X^{11}$ is selected from D, R, or K, wherein $X^{12}$ is selected from K, R, or D, wherein $X^{13}$ is selected from I or M, wherein $X^{14}$ is selected from S or G, wherein $X^{15}$ is selected from H or D, and wherein $X^{16}$ is selected from K, R, or null.

In some embodiments, a peptide comprises the sequence GSXVXVRCXGSRQCXPCRRXGXRXGRCINRRX-CRCYX (SEQ ID NO: 501) or GSXGCVXR-CRPGXRXCCXPXRRCSRRFGXRRCRX (SEQ ID NO: 502), wherein each letter is each individually any amino acid or amino acid analogue and where X is no amino acid or a 1-10 amino acid long peptide fragment wherein each amino acid within such peptide fragment can in each case be any amino acid or amino acid analogue. In some embodiments, a peptide comprises the sequence XVXVRCXGSRQCXPCRRXGXRXGRCINRRXCRCYX (SEQ ID NO: 775) or XGCVXR-CRPGXRXCCXPXRRCSRRFGXRRCRX (SEQ ID NO: 776), wherein each letter is each individually any amino acid or amino acid analogue and where X is no amino acid or a 1-10 amino acid long peptide fragment wherein each amino acid within such peptide fragment can in each case be any amino acid or amino acid analogue.

In some embodiments, a peptide comprises the sequence GSXVXXXVRCXGSRQCXXPCRRXXGXRXG RCINRRXCRCYXXX (SEQ ID NO: 503), XVXXXVRCXGSRQCXXPCRRXXGXRXGRCINRRX-CRCYXXX (SEQ ID NO: 777), GSXXXGCVXXXXR-CRPGXRXCCXPXRRCSRRFGXXXXRRCRXXXXXX (SEQ ID NO: 504), or XXXGCVXXXXR-CRPGXRXCCXPXRRCSRRFGXXXXRRCRXXXXXX (SEQ ID NO: 778) wherein X is no amino acid or any amino acid analogue.

In some embodiments, a peptide comprises the one or more of the following peptide fragments: GKCMNGKC (SEQ ID NO: 796); GRCMNGRC (SEQ ID NO: 797); GKCINKKCKC (SEQ ID NO: 782); KCGN (SEQ ID NO: 783); KKCK (SEQ ID NO: 784); PCKR (SEQ ID NO: 785); KRCSRR (SEQ ID NO: 786); KQC (SEQ ID NO: 787); GRCQNRRCRC (SEQ ID NO: 788); RCIN (SEQ ID NO: 789); RRCR (SEQ ID NO: 790); PCRR (SEQ ID NO: 791); RRCSRR (SEQ ID NO: 792); RQC (SEQ ID NO: 793); PCKK (SEQ ID NO: 794), and KKCSKK (SEQ ID NO: 795).

TABLE 51 lists some exemplary peptides according to the present disclosure.

TABLE 51

Exemplary Amino Acid Sequences

| SEQ ID NO: | Amino Acid Sequence |
|---|---|
| SEQ ID NO: 508 | GSGIVCKVCKIICGMQGKKVNICKAPIKCKCKKG |
| SEQ ID NO: 509 | GSSEKDCIKHLQRCRENKDCCSKKCSRRGTNPEKRCR |
| SEQ ID NO: 510 | GSVRIPVSCKHSGQCLKPCKDAGMRFGKCMNGKCDTPK |
| SEQ ID NO: 511 | GSGVPINVKCRGSRDCLDPCKKAGMRFGKCINSKCHCTP |
| SEQ ID NO: 512 | GSAVCVYRTCDKDCKRRGYRSGKCINNACKCYPYG |
| SEQ ID NO: 513 | GSISCTGSKQCYDPCKRKTGCPNAKCMNKSCKCYGCG |
| SEQ ID NO: 514 | GSQVQTNVKCQGGSCASVCRREIGVAAGKCINGKCVCYRN |
| SEQ ID NO: 515 | GSEVIRCSGSKQCYGPCKQQTGCTNSKCMNKVCKCYGCG |
| SEQ ID NO: 516 | GSACKGVFDACTPGKNECCPNRVCSDKHKWCKWKL |
| SEQ ID NO: 517 | GSQIYTSKECNGSSECYSHCEGITGKRSGKCINKKCYCYR |
| SEQ ID NO: 518 | GSGCLEFWWKCNPNDDKCCRPKLKCSKLFKLCNFSFG |
| SEQ ID NO: 519 | GSDCVRFWGKCSQTSDCCPHLACKSKWPRNICVWDGSVG |

TABLE 51-continued

Exemplary Amino Acid Sequences

| SEQ ID NO: | Amino Acid Sequence |
| --- | --- |
| SEQ ID NO: 520 | GSGCFGYKCDYYKGCCSGYVCSPTWKWCVRPGPGR |
| SEQ ID NO: 521 | GSMNAKFILLLVLTTMMLLPDTKGAEVIRCSGSKQCYGPCKQQTGCTNSKCMNKVCKCYGCG |
| SEQ ID NO: 522 | GSMNAKLIYLLLVVTTMTLMFDTAQAVDIMCSGPKQCYGPCKKETGCPNAKCMNRRCKCYGCV |
| SEQ ID NO: 523 | GSMNAKLIYLLLVVTTMMLTFDTTQAGDIKCSGTRQCWGPCKKQTTCTNSKCMNGKCKCYGCVG |
| SEQ ID NO: 524 | GSMNTKFIFLLLVVTNTMMLFDTKPVEGISCTGSKQCYDPCKRKTGCPNAKCMNKSCKCYGCG |
| SEQ ID NO: 525 | GSGVPINVKCSGSRDCLEPCKKAGMRFGKCINRKCHCTPK |
| SEQ ID NO: 526 | GSGVPINVKCTGSPQCLKPCKDAGMRFGKCINGKCHCTPK |
| SEQ ID NO: 527 | GSGVIINVKCKISRQCLEPCKKAGMRFGKCMNGKCHCTPK |
| SEQ ID NO: 528 | GSGVPINVKCRGSPQCIQPCRDAGMRFGKCMNGKCHCTPQ |
| SEQ ID NO: 529 | GSGVEINVKCTGSHQCIKPCKDAGMRFGKCINRKCHCTPK |
| SEQ ID NO: 530 | GSGVEINVKCSGSPQCLKPCKDAGMRFGKCMNRKCHCTPK |
| SEQ ID NO: 531 | GSGVPTDVKCRGSPQCIQPCKDAGMRFGKCMNGKCHCTPK |
| SEQ ID NO: 532 | GSGVPINVSCTGSPQCIKPCKDAGMRFGKCMNRKCHCTPK |
| SEQ ID NO: 533 | GSGVPINVPCTGSPQCIKPCKDAGMRFGKCMNRKCHCTPK |
| SEQ ID NO: 534 | GSVGINVKCKHSGQCLKPCKDAGMRFGKCINGKCDCTPK |
| SEQ ID NO: 535 | GSVGINVKCKHSGQCLKPCKDAGMRFGKCMNGKCDCTPK |
| SEQ ID NO: 536 | GSVGIPVSCKHSGQCIKPCKDAGMRFGKCMNRKCDCTPK |
| SEQ ID NO: 537 | GSRKGCFKEGHSCPKTAPCCRPLVCKGPSPNTKKCTRP |
| SEQ ID NO: 538 | GSSFCIPFKPCKSDENCCKKFKCKTTGIVKLCRW |
| SEQ ID NO: 539 | GSLKGCLPRNRFCNALSGPRCCSGLRCKELSIWASKCL |
| SEQ ID NO: 540 | GSGNYCLRGRCLPGGRKCCNGRPCECFAKICSCKPK |
| SEQ ID NO: 541 | GSTVKCGGCNRKCCPGGCRSGKCINGKCQCY |
| SEQ ID NO: 542 | GSGCMKEYCAGQCRGKVSQDYCLKHCKCIPR |
| SEQ ID NO: 543 | GSACLGFGEKCNPSNDKCCKSSSLVCSQKHKWCKYG |
| SEQ ID NO: 544 | GSRGGCLPHNRFCNALSGPRCCSGLRCKELSIRDSRCLG |
| SEQ ID NO: 545 | GSRGGCLPRNKFCNPSSGPRCCSGLTCKELNIWASKCL |
| SEQ ID NO: 546 | GSQRSCAKPGDMCMGIKCCDGQCGCNRGTGRCFCK |
| SEQ ID NO: 547 | GSARGCADAYKSCNHPRTCCDGYNGYKRACICSGSNCKCKKS |
| SEQ ID NO: 548 | GSRGGCLPHNRFCNALSGPRCCSGLRCKELSIWDSRCLG |
| SEQ ID NO: 549 | GSRGGCLPHNRFCNALSGPRCCSGLKCKELSIYDSRCLG |
| SEQ ID NO: 550 | GSRGGCLPHNRFCNALSGPRCCSRLKCKELSIWDSRCLG |
| SEQ ID NO: 551 | GSRGGCLPHNRFCNALTGPRCCSRLRCKELSIWDSICLG |
| SEQ ID NO: 552 | GSSCADAYKSCDSLKCCNNRTCMCSMIGTNCTCRKK |
| SEQ ID NO: 553 | GSERRCLPAGKTCVRGPMRVPCCGSCSQNKCT |
| SEQ ID NO: 554 | GSLCSREGEFCYKLRKCCAGFYCKAFVLHCYRN |
| SEQ ID NO: 555 | GSACGSCRKKCKGSGKCINGRCKCY |

TABLE 51-continued

Exemplary Amino Acid Sequences

| SEQ ID NO: | Amino Acid Sequence |
|---|---|
| SEQ ID NO: 556 | GSACGSCRKKCKGPGKCINGRCKCY |
| SEQ ID NO: 557 | GSACQGYMRKCGRDKPPCCKKLECSKTWRWCVWN |
| SEQ ID NO: 558 | GSGRYCQKWMWTCDSKRACCEGLRCKLWCRKI |
| SEQ ID NO: 559 | GSNAKCRGSPECLPKCKEAIGKAAGKCMNGKCKCYP |
| SEQ ID NO: 560 | GSNVKCRGSKECLPACKAAVGKAAGKCMNGKCKCYP |
| SEQ ID NO: 561 | GSNVKCRGSPECLPKCKEAIGKSAGKCMNGKCKCYP |
| SEQ ID NO: 562 | GSNAKCRGSPECLPKCKQAIGKAAGKCMNGKCKCYP |
| SEQ ID NO: 563 | GSRGYCAEKGIKCHNIHCCSGLTCKCKGSSCVCRK |
| SEQ ID NO: 564 | GSERGCKLTFWKCKNKKECCGWNACALGICMPR |
| SEQ ID NO: 565 | GSKKKCIAKDYGRCKWGGTPCCRGRGCICSIMGTNCECKPR |
| SEQ ID NO: 566 | GSGCKLTFWKCKNKKECCGWNACALGICMPR |
| SEQ ID NO: 567 | GSACKGLFVTCTPGKDECCPNHVCSSKHKWCKYK |
| SEQ ID NO: 568 | GSIACAPRGLLCFRDKECCKGLTCKGRFVNTWPTFCLV |
| SEQ ID NO: 569 | GSACAGLYKKCGKGVNTCCENRPCKCDLAMGNCICKKK |
| SEQ ID NO: 570 | GSFTCAISCDIKVNGKPCKGSGEKKCSGGWSCKFNVCVKV |
| SEQ ID NO: 571 | GSGFCAQKGIKCHDIHCCTNLKCVREGSNRVCRKA |
| SEQ ID NO: 572 | GSCAKKRNWCGKNEDCCCPMKCIYAWYNQQGSCQSTITGLFKKC |
| SEQ ID NO: 573 | GSYCQKWMWTCDSARKCCEGLVCRLWCKKI |
| SEQ ID NO: 574 | GSRGGCLPHNKFCNALSGPRCCSGLKCKELTIWNTKCLE |
| SEQ ID NO: 575 | GSNVKCTGSKQCLPACKAAVGKAAGKCMNGKCKCYT |
| SEQ ID NO: 576 | GSQRSCAKPGEMCMRIKCCDGQCGCNRGTGRCFCK |
| SEQ ID NO: 577 | GSGCIPKHKRCTWSGPKCCNNISCHCNISGTLCKCRPG |
| SEQ ID NO: 578 | GSNYCVAKRCRPGGRQCCSGKPCACVGKVCKCPRD |
| SEQ ID NO: 579 | GSERGCSGAYKRCSSSQRCCEGRPCVCSAINSNCKCRKT |
| SEQ ID NO: 580 | GSRYCPRNPEACYNYCLRTGRPGGYCGGRSRITCFCFR |
| SEQ ID NO: 581 | GSQRSCAKPGEMCMGIKCCDGQCGCNRGTGRCFCK |
| SEQ ID NO: 582 | GSRRGCFKEGKWCPKSAPCCAPLKCKGPSIKQQKCVRE |
| SEQ ID NO: 583 | GSTVKCGGCNRKCCAGGCRSGKCINGKCQCYGR |
| SEQ ID NO: 584 | GSERRCEPSGKPCRPLMRIPCCGSCVRGKCA |
| SEQ ID NO: 585 | GSRGGCLPRNKFCNPSSGPRCCSGLTCKELNIWANKCL |
| SEQ ID NO: 586 | GSCAKKRNWCGKNEDCCCPMKCIYAWYNQQGSCQTTITGLFKKC |
| SEQ ID NO: 587 | GSVRIPVSCKHSGQCLKPCKDAGMRTGKCMNGKCDCTPK |
| SEQ ID NO: 588 | GSVKCTTSKDCWPPCKKVTGRA |
| SEQ ID NO: 589 | GSGIVCRVCRIICGMQGRRVNICRAPIRCRCRRG |
| SEQ ID NO: 590 | GSSERDCIRHLQRCRENRDCCSRRCSRRGTNPERRCR |
| SEQ ID NO: 591 | GSVRIPVSCRHSGQCLRPCRDAGMRFGRCMNGRCDCTPR |
| SEQ ID NO: 592 | GSGVPINVRCRGSRDCLDPCRRAGMRFGRCINSRCHCTP |
| SEQ ID NO: 593 | GSAVCVYRTCDRDCRRRGYRSGRCINNACRCYPYG |

TABLE 51-continued

Exemplary Amino Acid Sequences

| SEQ ID NO: | Amino Acid Sequence |
|---|---|
| SEQ ID NO: 594 | GSISCTGSRQCYDPCRRRTGCPNARCMNRSCRCYGCG |
| SEQ ID NO: 595 | GSQVQTNVRCQGGSCASVCRREIGVAAGRCINGRCVCYRN |
| SEQ ID NO: 596 | GSEVIRCSGSRQCYGPCRQQTGCTNSRCMNRVCRCYGCG |
| SEQ ID NO: 597 | GSACRGVFDACTPGRNECCPNRVCSDRHRWCRWRL |
| SEQ ID NO: 598 | GSQIYTSRECNGSSECYSHCEGITGRRSGRCINRRCYCYR |
| SEQ ID NO: 599 | GSGCLEFWWRCNPNDDRCCRPRLRCSRLFRLCNFSFG |
| SEQ ID NO: 600 | GSDCVRFWGRCSQTSDCCPHLACRSRWPRNICVWDGSVG |
| SEQ ID NO: 601 | GSGCFGYRCDYYRGCCSGYVCSPTWRWCVRPGPGR |
| SEQ ID NO: 602 | GSMNARFILLLVLTTMMLLPDTRGAEVIRCSGSRQCYGPCRQQTGCTNSRCMNRVCRCYGCG |
| SEQ ID NO: 603 | GSMNARLIYLLLVVTTMTLMFDTAQAVDIMCSGPRQCYGPCRRETGCPNARCMNRRCRCYGCV |
| SEQ ID NO: 604 | GSMNARLIYLLLVVTTMMLTFDTTQAGDIRCSGTRQCWGPCRRQTTCTNSRCMNGRCRCYGCVG |
| SEQ ID NO: 605 | GSMNTRFIFLLLLVVTNTMMLFDTRPVEGISCTGSRQCYDPCRRRTGCPNARCMNRSCRCYGCG |
| SEQ ID NO: 606 | GSGVPINVRCSGSRDCLEPCRRAGMRFGRCINRRCHCTPR |
| SEQ ID NO: 607 | GSGVPINVRCTGSPQCLRPCRDAGMRFGRCINGRCHCTPR |
| SEQ ID NO: 608 | GSGVIINVRCRISRQCLEPCRRAGMRFGRCMNGRCHCTPR |
| SEQ ID NO: 609 | GSGVPINVRCRGSPQCIQPCRDAGMRFGRCMNGRCHCTPQ |
| SEQ ID NO: 610 | GSGVEINVRCTGSHQCIRPCRDAGMRFGRCINRRCHCTPR |
| SEQ ID NO: 611 | GSGVEINVRCSGSPQCLRPCRDAGMRFGRCMNRRCHCTPR |
| SEQ ID NO: 612 | GSGVPTDVRCRGSPQCIQPCRDAGMRFGRCMNGRCHCTPR |
| SEQ ID NO: 613 | GSGVPINVSCTGSPQCIRPCRDAGMRFGRCMNRRCHCTPR |
| SEQ ID NO: 614 | GSGVPINVPCTGSPQCIRPCRDAGMRFGRCMNRRCHCTPR |
| SEQ ID NO: 615 | GSVGINVRCRHSGQCLRPCRDAGMRFGRCINGRCDCTPR |
| SEQ ID NO: 616 | GSVGINVRCRHSGQCLRPCRDAGMRFGRCMNGRCDCTPR |
| SEQ ID NO: 617 | GSVGIPVSCRHSGQCIRPCRDAGMRFGRCMNRRCDCTPR |
| SEQ ID NO: 618 | GSRRGCFREGHSCPRTAPCCRPLVCRGPSPNTRRCTRP |
| SEQ ID NO: 619 | GSSFCIPFRPCRSDENCCRRFRCRTTGIVRLCRW |
| SEQ ID NO: 620 | GSLRGCLPRNRFCNALSGPRCCSGLRCRELSIWASRCL |
| SEQ ID NO: 621 | GSGNYCLRGRCLPGGRRCCNGRPCECFARICSCRPR |
| SEQ ID NO: 622 | GSTVRCGGCNRRCCPGGCRSGRCINGRCQCY |
| SEQ ID NO: 623 | GSGCMREYCAGQCRGRVSQDYCLRHCRCIPR |
| SEQ ID NO: 624 | GSACLGFGERCNPSNDRCCRSSSLVCSQRHRWCRYG |
| SEQ ID NO: 625 | GSRGGCLPHNRFCNALSGPRCCSGLRCRELSIRDSRCLG |
| SEQ ID NO: 626 | GSRGGCLPRNRFCNPSSGPRCCSGLTCRELNIWASRCL |
| SEQ ID NO: 627 | GSQRSCARPGDMCMGIRCCDGQCGCNRGTGRCFCR |
| SEQ ID NO: 628 | GSARGCADAYRSCNHPRTCCDGYNGYRRACICSGSNCRCRRS |
| SEQ ID NO: 629 | GSRGGCLPHNRFCNALSGPRCCSGLRCRELSIWDSRCLG |

TABLE 51-continued

Exemplary Amino Acid Sequences

| SEQ ID NO: | Amino Acid Sequence |
|---|---|
| SEQ ID NO: 630 | GSRGGCLPHNRFCNALSGPRCCSGLRCRELSIYDSRCLG |
| SEQ ID NO: 631 | GSRGGCLPHNRFCNALSGPRCCSRLRCRELSIWDSRCLG |
| SEQ ID NO: 632 | GSRGGCLPHNRFCNALTGPRCCSRLRCRELSIWDSICLG |
| SEQ ID NO: 633 | GSSCADAYKSCDSLRCCNNRTCMCSMIGTNCTCRRR |
| SEQ ID NO: 634 | GSERRCLPAGRTCVRGPMRVPCCGSCSQNRCT |
| SEQ ID NO: 635 | GSLCSREGEFCYRLRRCCAGFYCRAFVLHCYRN |
| SEQ ID NO: 636 | GSACGSCRRRCRGSGRCINGRCRCY |
| SEQ ID NO: 637 | GSACGSCRRRCRGPGRCINGRCRCY |
| SEQ ID NO: 638 | GSACQGYMRRCGRDRPPCCRRLECSRTWRWCVWN |
| SEQ ID NO: 639 | GSGRYCQRWMWTCDSRRACCEGLRCRLWCRRI |
| SEQ ID NO: 640 | GSNARCRGSPECLPRCREAIGRAAGRCMNGRCRCYP |
| SEQ ID NO: 641 | GSNVRCRGSRECLPACRAAVGRAAGRCMNGRCRCYP |
| SEQ ID NO: 642 | GSNVRCRGSPECLPRCREAIGRSAGRCMNGRCRCYP |
| SEQ ID NO: 643 | GSNARCRGSPECLPRCRQAIGRAAGRCMNGRCRCYP |
| SEQ ID NO: 644 | GSRGYCAERGIRCHNIHCCSGLTCRCRGSSCVCRR |
| SEQ ID NO: 645 | GSERGCRLTFWRCRNRRECCGWNACALGICMPR |
| SEQ ID NO: 646 | GSRRRCIARDYGRCRWGGTPCCRGRGCICSIMGTNCECRPR |
| SEQ ID NO: 647 | GSGCRLTFWRCRNRRECCGWNACALGICMPR |
| SEQ ID NO: 648 | GSACRGLFVTCTPGRDECCPNHVCSSRHRWCRYR |
| SEQ ID NO: 649 | GSIACAPRGLLCFRDRECCRGLTCRGRFVNTWPTFCLV |
| SEQ ID NO: 650 | GSACAGLYRRCGRGVNTCCENRPCRCDLAMGNCICRRR |
| SEQ ID NO: 651 | GSFTCAISCDIRVNGRPCRGSGERRCSGGWSCRFNVCVRV |
| SEQ ID NO: 652 | GSGFCAQRGIRCHDIHCCTNLRCVREGSNRVCRRA |
| SEQ ID NO: 653 | GSCARRRNWCGRNEDCCCPMRCIYAWYNQQGSCQSTITGLFRRC |
| SEQ ID NO: 654 | GSYCQRWMWTCDSARRCCEGLVCRLWCRRI |
| SEQ ID NO: 655 | GSRGGCLPHNRFCNALSGPRCCSGLRCRELTIWNTRCLE |
| SEQ ID NO: 656 | GSNVRCTGSRQCLPACRAAVGRAAGRCMNGRCRCYT |
| SEQ ID NO: 657 | GSQRSCARPGEMCMRIRCCDGQCGCNRGTGRCFCR |
| SEQ ID NO: 658 | GSGCIPRHRRCTWSGPRCCNNISCHCNISGTLCRCRPG |
| SEQ ID NO: 659 | GSNYCVARRCRPGGRQCCSGRPCACVGRVCRCPRD |
| SEQ ID NO: 660 | GSERGCSGAYRRCSSSQRCCEGRPCVCSAINSNCRCRRT |
| SEQ ID NO: 661 | GSQRSCARPGEMCMGIRCCDGQCGCNRGTGRCFCR |
| SEQ ID NO: 662 | GSRRGCFREGRWCPRSAPCCAPLRCRGPSIRQQRCVRE |
| SEQ ID NO: 663 | GSTVRCGGCNRRCCAGGCRSGRCINGRCQCYGR |
| SEQ ID NO: 664 | GSERRCEPSGRPCRPLMRIPCCGSCVRGRCA |
| SEQ ID NO: 665 | GSRGGCLPRNRFCNPSSGPRCCSGLTCRELNIWANRCL |
| SEQ ID NO: 666 | GSCARRRNWCGRNEDCCCPMRCIYAWYNQQGSCQTTITGLFRRC |
| SEQ ID NO: 667 | GSVRIPVSCRHSGQCLRPCRDAGMRTGRCMNGRCDCTPR |

TABLE 51-continued

Exemplary Amino Acid Sequences

| SEQ ID NO: | Amino Acid Sequence |
|---|---|
| SEQ ID NO: 668 | GSQKILSNRCNNSSECIPHCIRIFGTRAAKCINRKCYCYP |
| SEQ ID NO: 669 | GSAVCNLKRCQLSCRSLGLLGKCIGDKCECVKHG |
| SEQ ID NO: 670 | GSISIGIRCSPSIDLCEGQCRIRRYFTGYCSGDTCHCSG |
| SEQ ID NO: 671 | GSGDCLPHLRRCRENNDCCSRRCRRRGANPERRCR |
| SEQ ID NO: 672 | GSSCEPGRTFRDRCNTCKCGADGRSAACTLRACPNQ |
| SEQ ID NO: 673 | GSGDCLPHLKRCKADNDCCGKKCKRRGTNAEKRCR |
| SEQ ID NO: 674 | GSGDCLPHLKRCKENNDCCSKKCKRRGTNPEKRCR |
| SEQ ID NO: 675 | GSKDCLKKLKLCKENKDCCSKSCKRRGTNIEKRCR |
| SEQ ID NO: 676 | GSGDCLPHLKRCKENNDCCSKKCKRRGANPEKRCR |
| SEQ ID NO: 677 | GSVFINVKCRGSPECLPKCKEAIGKSAGKCMNGKCKCYP |
| SEQ ID NO: 678 | GSVFINAKCRGSPECLPKCKEAIGKAAGKCMNGKCKCYP |
| SEQ ID NO: 679 | GSVIINVKCKISRQCLEPCKKAGMRFGKCMNGKCHCTP |
| SEQ ID NO: 680 | GSVPTDVKCRGSPQCIQPCKDAGMRFGKCMNGKCHCTP |
| SEQ ID NO: 681 | GSVRIPVSCKHSGQCLKPCKDAGMRFGKCMNGKCDCTP |
| SEQ ID NO: 682 | GSVRIPVSCRHSGQCLRPCRDAGMRFGRCMNGRCDCTP |
| SEQ ID NO: 683 | GSTNVSCTTSKECWSVCQRLHNTSRGKCMNKKCRC |
| SEQ ID NO: 684 | GSNVKCTGSKQCLPACKAAVGKAAGKCMNGKCKC |
| SEQ ID NO: 685 | GSGVPINVRCRGSRDCLDPCRGAGERHGRCGNSRCHCTP |
| SEQ ID NO: 686 | GSVRIPVSCRHSGQCLRPCRDAGERHGRCGGGRCDCTPR |
| SEQ ID NO: 687 | GSQVQTNVRCQGGSCGSVCRREGGGAGGGCGNGRCGCYRN |
| SEQ ID NO: 688 | GSIKCSESYQCFPVCKSRFGKTNGRCVNGFCDCF |
| SEQ ID NO: 689 | GSVKCSSPQQCLKPCKAAFGISAGGKCINGKCKCY |
| SEQ ID NO: 690 | GSVSCSASSQCWPVCKKLFGTYRGKCMNSKCRCY |
| SEQ ID NO: 691 | GSESCTASNQCWSICKRLHNTNRGKCMNKKCRCY |
| SEQ ID NO: 692 | GSVSCTTSKECWSVCEKLYNTSRGKCMNKKCRCY |
| SEQ ID NO: 693 | GSMRCKSSKECLVKCKQATGRPNGKCMNRKCKCY |
| SEQ ID NO: 694 | GSIKCTLSKDCYSPCKKETGCPRAKCINRNCKCY |
| SEQ ID NO: 695 | GSIRCSGSRDCYSPCMKQTGCPNAKCINKSCKCY |
| SEQ ID NO: 696 | GSIRCSGTRECYAPCQKLTGCLNAKCMNKACKCY |
| SEQ ID NO: 697 | GSISCTNPKQCYPHCKKETGYPNAKCMNRKCKCF |
| SEQ ID NO: 698 | GSASCRTPKDCADPCRKETGCPYGKCMNRKCKCN |
| SEQ ID NO: 699 | GSTSCISPKQCTEPCRAKGCKHGKCMNRKCHCM |
| SEQ ID NO: 700 | GSKECTGPQHCTNFCRKN-KCTHGKCMNRKCKCF |
| SEQ ID NO: 701 | GSIKCRTPKDCADPCRKQTGCPHAKCMNKTCRCH |
| SEQ ID NO: 702 | GSVKCTTSKECWPPCKAATGKAAGKCMNKKCKCQ |
| SEQ ID NO: 703 | GSLECGASRECYDPCFKAFGRAHGKCMNNKCRCY |
| SEQ ID NO: 704 | GSEKCFATSQCWTPCKKAIGSLQSKCMNGKCKCY |
| SEQ ID NO: 705 | GSVRCYASRECWEPCRRVTGSAQAKCQNNQCRCY |

TABLE 51-continued

Exemplary Amino Acid Sequences

| SEQ ID NO: | Amino Acid Sequence |
|---|---|
| SEQ ID NO: 706 | GSVKCSASRECWVACKKVTGSGQGKCQNNQCRCY |
| SEQ ID NO: 707 | GSVKCISSQECWIACKKVTGRFEGKCQNRQCRCY |
| SEQ ID NO: 708 | GSVRCYDSRQCWIACKKVTGSTQGKCQNKQCRCY |
| SEQ ID NO: 709 | GSVDCTVSKECWAPCKAAFGVDRGKCMGKKCKCY |
| SEQ ID NO: 710 | GSAKCRGSPECLPKCKEAIGKAAGKCMNGKCKCY |
| SEQ ID NO: 711 | GSKKCQGGSCASVCRRVIGVAAGKCINGRCVCY |
| SEQ ID NO: 712 | GSKKCSNTSQCYKTCEKVVGVAAGKCMNGKCICY |
| SEQ ID NO: 713 | GSVKCSGSSKCVKICIDRYNTRGAKCINGRCTCY |
| SEQ ID NO: 714 | GSNRCNNSSECIPHCIRIFGTRAAKCINRKCYCY |
| SEQ ID NO: 715 | GSKECNGSSECYSHCEGITGKRSGKCINKKCYCY |
| SEQ ID NO: 716 | GSAFCNLRRCELSCRSLGLLGKCIGEECKCV |
| SEQ ID NO: 717 | GSAVCNLKRCQLSCRSLGLLGKCIGDKCECV |
| SEQ ID NO: 718 | GSAACYSS-DCRVKCVAMGFSSGKCINSKCKCY |
| SEQ ID NO: 719 | GSAICATDADCSRKCPGNPPCRNGFCACT |
| SEQ ID NO: 720 | GSTECQIKNDCQRYCQSVKECKYGKCYCN |
| SEQ ID NO: 721 | GSTQCQSVRDCQQYCLTPDRCSYGTCYCK |
| SEQ ID NO: 722 | GSVSCRYGSDCAEPCKRLKCLLPSKCINGKCTCY |
| SEQ ID NO: 723 | GSIKCRYPADCHIMCRKVTGRAEGKCMNGKCTCY |
| SEQ ID NO: 724 | GSIKCSSSSSCYEPCRGVTGRAHGKCMNGRCTCY |
| SEQ ID NO: 725 | GSVKCTGSKQCLPACKAAVGKAAGKCMNGKCKCY |
| SEQ ID NO: 726 | GSVSCKHSGQCIKPCKDA-GMRFGKCMNRKCDCT |
| SEQ ID NO: 727 | GSVKCRGSPQCIQPCRDA-GMRFGKCMNGKCHCT |
| SEQ ID NO: 728 | GSVKCTSPKQCLPPCKAQFGIRAGAKCMNGKCKCY |
| SEQ ID NO: 729 | GSVKCTSPKQCSKPCKELYGSSAGAKCMNGKCKCY |
| SEQ ID NO: 730 | GSVKCTSPKQCLPPCKEIYGRHAGAKCMNGKCHCS |
| SEQ ID NO: 731 | GSVKCTGSKQCWPVCKQMFGKPNGKCMNGKCRCY |
| SEQ ID NO: 732 | GSVKCRGSRDCLDPCKKAGMRFGKCINSKCHCT |
| SEQ ID NO: 733 | GSVRCVTDDDCFRKCPGNPSCKRGFCACK |
| SEQ ID NO: 734 | GSVPCNNSRPCVPVCIREVNNKNGKCSNGKCLCY |
| SEQ ID NO: 735 | GSVPINVKCRGSRDCLDPCKKAGMRFGKCINSKCHCTP |
| SEQ ID NO: 736 | GSVQTNVKCQGGSCASVCRREIGVAAGKCINGKCVCYRN |
| SEQ ID NO: 737 | GSAEIIRCSGTRECYAPCQKLTGCLNAKCMNKACKCYGCV |
| SEQ ID NO: 738 | GSRPTDIKCSASYQCFPVCKSRFGKTNGRCVNGLCDCF |
| SEQ ID NO: 739 | GSQFTDVKCTGSKQCWPVCKQMFGKPNGKCMNGKCRCYS |
| SEQ ID NO: 740 | GSVGINVKCKHSRQCLKPCKDAGMRFGKCTNGKCHCTPK |
| SEQ ID NO: 741 | GSVVIGQRCYRSPDCYSACKKLVGKATGKCTNGRCDC |
| SEQ ID NO: 742 | GSNFKVEGACSKPCRKYCIDKGARNGKCINGRCHCYY |
| SEQ ID NO: 743 | GSQIDTNVKCSGSSKCVKICIDRYNTRGAKCINGRCTCYP |

TABLE 51-continued

Exemplary Amino Acid Sequences

| SEQ ID NO: | Amino Acid Sequence |
|---|---|
| SEQ ID NO: 744 | GSGVPISVRCRGSRDCLEPCRRAGTRFGRCINGRCHCTP |
| SEQ ID NO: 745 | GSGVPISVRCRGSRDCLEPCRRAGTRFGRCIQSRCHCTP |
| SEQ ID NO: 746 | GSGVPISVRCRGSRDCLEPCRRAGTRFGRCINRRCHCTP |
| SEQ ID NO: 747 | GSGVPINVRCRGSRDCLEPCRRAGTRFGRCINSRCHCTP |
| SEQ ID NO: 748 | GSGVPINVRCRGSRDCLEPCRRAGTRFGRCIQSRCHCTP |
| SEQ ID NO: 749 | GSGVPINVRCRGSRDCLEPCRRAGTRFGRCIQSRCHCYP |
| SEQ ID NO: 750 | GSGVPINVRCRGSRDCYEPCRRAGTRFGRCIQSRCHCTP |
| SEQ ID NO: 751 | GSGVPINVRCRGSRDCLEPCRRAGTRFGRCIQSRCYCTP |
| SEQ ID NO: 752 | GSGVPISVRCRGSRDCLEPCRRAGTRFGRCIQSRCHCYP |
| SEQ ID NO: 753 | GSGVPISVRCRGSRDCYEPCRRAGTRFGRCIQSRCHCTP |
| SEQ ID NO: 754 | GSGVPISVRCRGSRDCLEPCRRAGTRFGRCIQSRCYCTP |
| SEQ ID NO: 755 | GSGVPINVRCRGSRDCLEPCRRAGTRFGRCIASRCHCYP |
| SEQ ID NO: 756 | GSGVPINVRCRGSRDCLEPCRRAGTRFGRCISSRCHCYP |
| SEQ ID NO: 757 | GSGVPINVRCRGSRDCLEPCRRAGTRFGRCITSRCHCYP |
| SEQ ID NO: 758 | GSGVPINVRCRGSRDCLEPCRRAGTRFGRCINSRCHCYP |
| SEQ ID NO: 798 | GIVCKVCKIICGMQGKKVNICKAPIKCKCKKG |
| SEQ ID NO: 799 | SEKDCIKHLQRCRENKDCCSKKCSRRGTNPEKRCR |
| SEQ ID NO: 800 | VRIPVSCKHSGQCLKPCKDAGMRFGKCMNGKCDCTPK |
| SEQ ID NO: 801 | GVPINVKCRGSRDCLDPCKKAGMRFGKCINSKCHCTP |
| SEQ ID NO: 802 | AVCVYRTCDKDCKRRGYRSGKCINNACKCYPYG |
| SEQ ID NO: 803 | ISCTGSKQCYDPCKRKTGCPNAKCMNKSCKCYGCG |
| SEQ ID NO: 804 | QVQTNVKCQGGSCASVCRREIGVAAGKCINGKCVCYRN |
| SEQ ID NO: 805 | EVIRCSGSKQCYGPCKQQTGCTNSKCMNKVCKCYGCG |
| SEQ ID NO: 806 | ACKGVFDACTPGKNECCPNRVCSDKHKWCKWKL |
| SEQ ID NO: 807 | QIYTSKECNGSSECYSHCEGITGKRSGKCINKKCYCYR |
| SEQ ID NO: 808 | GCLEFWWKCNPNDDKCCRPKLKCSKLFKLCNFSFG |
| SEQ ID NO: 809 | DCVRFWGKCSQTSDCCPHLACKSKWPRNICVWDGSVG |
| SEQ ID NO: 810 | GCFGYKCDYYKGCCSGYVCSPTWKWCVRPGPGR |
| SEQ ID NO: 811 | MNAKFILLLVLTTMMLLPDTKGAEVIRCSGSKQCYGPCKQQTGCTNSKCMNKVCKCYGCG |
| SEQ ID NO: 812 | MNAKLIYLLLVVTTMTLMFDTAQAVDIMCSGPKQCYGPCKKETGCPNAKCMNRRCKCYGCV |
| SEQ ID NO: 813 | MNAKLIYLLLVVTTMMLTFDTTQAGDIKCSGTRQCWGPCKKQTTCTNSKCMNGKCKCYGCVG |
| SEQ ID NO: 814 | MNTKFIFLLLVVTNTMMLFDTKPVEGISCTGSKQCYDPCKRKTGCPNAKCMNKSCKCYGCG |
| SEQ ID NO: 815 | GVPINVKCSGSRDCLEPCKKAGMRFGKCINRKCHCTPK |
| SEQ ID NO: 816 | GVPINVKCTGSPQCLKPCKDAGMRFGKCINGKCHCTPK |
| SEQ ID NO: 817 | GVIINVKCKISRQCLEPCKKAGMRFGKCMNGKCHCTPK |
| SEQ ID NO: 818 | GVPINVKCRGSPQCIQPCRDAGMRFGKCMNGKCHCTPQ |

TABLE 51-continued

Exemplary Amino Acid Sequences

| SEQ ID NO: | Amino Acid Sequence |
| --- | --- |
| SEQ ID NO: 819 | GVEINVKCTGSHQCIKPCKDAGMRFGKCINRKCHCTPK |
| SEQ ID NO: 820 | GVEINVKCSGSPQCLKPCKDAGMRFGKCMNRKCHCTPK |
| SEQ ID NO: 821 | GVPTDVKCRGSPQCIQPCKDAGMRFGKCMNGKCHCTPK |
| SEQ ID NO: 822 | GVPINVSCTGSPQCIKPCKDAGMRFGKCMNRKCHCTPK |
| SEQ ID NO: 823 | GVPINVPCTGSPQCIKPCKDAGMRFGKCMNRKCHCTPK |
| SEQ ID NO: 824 | VGINVKCKHSGQCLKPCKDAGMRFGKCINGKCDCTPK |
| SEQ ID NO: 825 | VGINVKCKHSGQCLKPCKDAGMRFGKCMNGKCDCTPK |
| SEQ ID NO: 826 | VGIPVSCKHSGQCIKPCKDAGMRFGKCMNRKCDCTPK |
| SEQ ID NO: 827 | RKGCFKEGHSCPKTAPCCRPLVCKGPSPNTKKCTRP |
| SEQ ID NO: 828 | SFCIPFKPCKSDENCCKKFKCKTTGIVKLCRW |
| SEQ ID NO: 829 | LKGCLPRNRFCNALSGPRCCSGLRCKELSIWASKCL |
| SEQ ID NO: 830 | GNYCLRGRCLPGGRKCCNGRPCECFAKICSCKPK |
| SEQ ID NO: 831 | TVKCGGCNRKCCPGGCRSGKCINGKCQCY |
| SEQ ID NO: 832 | GCMKEYCAGQCRGKVSQDYCLKHCKCIPR |
| SEQ ID NO: 833 | ACLGFGEKCNPSNDKCCKSSSLVCSQKHKWCKYG |
| SEQ ID NO: 834 | RGGCLPHNRFCNALSGPRCCSGLRCKELSIRDSRCLG |
| SEQ ID NO: 835 | RGGCLPRNKFCNPSSGPRCCSGLTCKELNIWASKCL |
| SEQ ID NO: 836 | QRSCAKPGDMCMGIKCCDGQCGCNRGTGRCFCK |
| SEQ ID NO: 837 | ARGCADAYKSCNHPRTCCDGYNGYKRACICSGSNCKCKKS |
| SEQ ID NO: 838 | RGGCLPHNRFCNALSGPRCCSGLRCKELSIWDSRCLG |
| SEQ ID NO: 839 | RGGCLPHNRFCNALSGPRCCSGLKCKELSIYDSRCLG |
| SEQ ID NO: 840 | RGGCLPHNRFCNALSGPRCCSRLKCKELSIWDSRCLG |
| SEQ ID NO: 841 | RGGCLPHNRFCNALTGPRCCSRLRCKELSIWDSICLG |
| SEQ ID NO: 842 | SCADAYKSCDSLKCCNNRTCMCSMIGTNCTCRKK |
| SEQ ID NO: 843 | ERRCLPAGKTCVRGPMRVPCCGSCSQNKCT |
| SEQ ID NO: 844 | LCSREGEFCYKLRKCCAGFYCKAFVLHCYRN |
| SEQ ID NO: 845 | ACGSCRKKCKGSGKCINGRCKCY |
| SEQ ID NO: 846 | ACGSCRKKCKGPGKCINGRCKCY |
| SEQ ID NO: 847 | ACQGYMRKCGRDKPPCCKKLECSKTWRWCVWN |
| SEQ ID NO: 848 | GRYCQKWMWTCDSKRACCEGLRCKLWCRKI |
| SEQ ID NO: 849 | NAKCRGSPECLPKCKEAIGKAAGKCMNGKCKCYP |
| SEQ ID NO: 850 | NVKCRGSKECLPACKAAVGKAAGKCMNGKCKCYP |
| SEQ ID NO: 851 | NVKCRGSPECLPKCKEAIGKSAGKCMNGKCKCYP |
| SEQ ID NO: 852 | NAKCRGSPECLPKCKQAIGKAAGKCMNGKCKCYP |
| SEQ ID NO: 853 | RGYCAEKGIKCHNIHCCSGLTCKCKGSSCVCRK |
| SEQ ID NO: 854 | ERGCKLTFWKCKNKKECCGWNACALGICMPR |
| SEQ ID NO: 855 | KKKCIAKDYGRCKWGGTPCCRGRGCICSIMGTNCECKPR |
| SEQ ID NO: 856 | GCKLTFWKCKNKKECCGWNACALGICMPR |

TABLE 51-continued

Exemplary Amino Acid Sequences

| SEQ ID NO: | Amino Acid Sequence |
|---|---|
| SEQ ID NO: 857 | ACKGLFVTCTPGKDECCPNHVCSSKHKWCKYK |
| SEQ ID NO: 858 | IACAPRGLLCFRDKECCKGLTCKGRFVNTWPTFCLV |
| SEQ ID NO: 859 | ACAGLYKKCGKGVNTCCENRPCKCDLAMGNCICKKK |
| SEQ ID NO: 860 | FTCAISCDIKVNGKPCKGSGEKKCSGGWSCKFNVCVKV |
| SEQ ID NO: 861 | GFCAQKGIKCHDIHCCTNLKCVREGSNRVCRKA |
| SEQ ID NO: 862 | CAKKRNWCGKNEDCCCPMKCIYAWYNQQGSCQSTITGLFKKC |
| SEQ ID NO: 863 | YCQKWMWTCDSARKCCEGLVCRLWCKKI |
| SEQ ID NO: 864 | RGGCLPHNKFCNALSGPRCCSGLKCKELTIWNTKCLE |
| SEQ ID NO: 865 | NVKCTGSKQCLPACKAAVGKAAGKCMNGKCKCYT |
| SEQ ID NO: 866 | QRSCAKPGEMCMRIKCCDGQCGCNRGTGRCFCK |
| SEQ ID NO: 867 | GCIPKHKRCTWSGPKCCNNISCHCNISGTLCKCRPG |
| SEQ ID NO: 868 | NYCVAKRCRPGGRQCCSGKPCACVGKVCKCPRD |
| SEQ ID NO: 869 | ERGCSGAYKRCSSSQRCCEGRPCVCSAINSNCKCRKT |
| SEQ ID NO: 870 | RYCPRNPEACYNYCLRTGRPGGYCGGRSRITCFCFR |
| SEQ ID NO: 871 | QRSCAKPGEMCMGIKCCDGQCGCNRGTGRCFCK |
| SEQ ID NO: 872 | RRGCFKEGKWCPKSAPCCAPLKCKGPSIKQQKCVRE |
| SEQ ID NO: 873 | TVKCGGCNRKCCAGGCRSGKCINGKCQCYGR |
| SEQ ID NO: 874 | ERRCEPSGKPCRPLMRIPCCGSCVRGKCA |
| SEQ ID NO: 875 | RGGCLPRNKFCNPSSGPRCCSGLTCKELNIWANKCL |
| SEQ ID NO: 876 | CAKKRNWCGKNEDCCCPMKCIYAWYNQQGSCQTTITGLFKKC |
| SEQ ID NO: 877 | VRIPVSCKHSGQCLKPCKDAGMRTGKCMNGKCDCTPK |
| SEQ ID NO: 878 | VKCTTSKDCWPPCKKVTGRA |
| SEQ ID NO: 879 | GIVCRVCRIICGMQGRRVNICRAPIRCRCRRG |
| SEQ ID NO: 880 | SERDCIRHLQRCRENRDCCSRRCSRRGTNPERRCR |
| SEQ ID NO: 881 | VRIPVSCRHSGQCLRPCRDAGMRFGRCMNGRCDCTPR |
| SEQ ID NO: 882 | GVPINVRCRGSRDCLDPCRRAGMRFGRCINSRCHCTP |
| SEQ ID NO: 883 | AVCVYRTCDRDCRRGYRSGRCINNACRCYPYG |
| SEQ ID NO: 884 | ISCTGSRQCYDPCRRRTGCPNARCMNRSCRCYGCG |
| SEQ ID NO: 885 | QVQTNVRCQGGSCASVCRREIGVAAGRCINGRCVCYRN |
| SEQ ID NO: 886 | EVIRCSGSRQCYGPCRQQTGCTNSRCMNRVCRCYGCG |
| SEQ ID NO: 887 | ACRGVFDACTPGRNECCPNRVCSDRHRWCRWRL |
| SEQ ID NO: 888 | QIYTSRECNGSSECYSHCEGITGRRSGRCINRRCYCYR |
| SEQ ID NO: 889 | GCLEFWWRCNPNDDRCCRPRLRCSRLFRLCNFSFG |
| SEQ ID NO: 890 | DCVRFWGRCSQTSDCCPHLACRSRWPRNICVWDGSVG |
| SEQ ID NO: 891 | GCFGYRCDYYRGCCSGYVCSPTWRWCVRPGPGR |
| SEQ ID NO: 892 | MNARFILLLVLTTMMLLPDTRGAEVIRCSGSRQCYGPCRQQTGCTNSRCMNRVCRCYGCG |
| SEQ ID NO: 893 | MNARLIYLLLVVTTMTLMFDTAQAVDIMCSGPRQCYGPCRRETGCPNARCMNRRCRCYGCV |

TABLE 51-continued

Exemplary Amino Acid Sequences

| SEQ ID NO: | Amino Acid Sequence |
|---|---|
| SEQ ID NO: 894 | MNARLIYLLLVVTTMMLTFDTTQAGDIRCSGTRQCWGPCRRQTTCTNSRCMNGRCRCYGCVG |
| SEQ ID NO: 895 | MNTRFIFLLLVVTNTMMLFDTRPVEGISCTGSRQCYDPCRRRTGCPNARCMNRSCRCYGCG |
| SEQ ID NO: 896 | GVPINVRCSGSRDCLEPCRRAGMRFGRCINRRCHCTPR |
| SEQ ID NO: 897 | GVPINVRCTGSPQCLRPCRDAGMRFGRCINGRCHCTPR |
| SEQ ID NO: 898 | GVIINVRCISRQCLEPCRRAGMRFGRCMNGRCHCTPR |
| SEQ ID NO: 899 | GVPINVRCRGSPQCIQPCRDAGMRFGRCMNGRCHCTPQ |
| SEQ ID NO: 900 | GVEINVRCTGSHQCIRPCRDAGMRFGRCINRRCHCTPR |
| SEQ ID NO: 901 | GVEINVRCSGSPQCLRPCRDAGMRFGRCMNRRCHCTPR |
| SEQ ID NO: 902 | GVPTDVRCRGSPQCIQPCRDAGMRFGRCMNGRCHCTPR |
| SEQ ID NO: 903 | GVPINVSCTGSPQCIRPCRDAGMRFGRCMNRRCHCTPR |
| SEQ ID NO: 904 | GVPINVPCTGSPQCIRPCRDAGMRFGRCMNRRCHCTPR |
| SEQ ID NO: 905 | VGINVRCRHSGQCLRPCRDAGMRFGRCINGRCDCTPR |
| SEQ ID NO: 906 | VGINVRCRHSGQCLRPCRDAGMRFGRCMNGRCDCTPR |
| SEQ ID NO: 907 | VGIPVSCRHSGQCIRPCRDAGMRFGRCMNRRCDCTPR |
| SEQ ID NO: 908 | RRGCFREGHSCPRTAPCCRPLVCRGPSPNTRRCTRP |
| SEQ ID NO: 909 | SFCIPFRPCRSDENCCRRFRCRTTGIVRLCRW |
| SEQ ID NO: 910 | LRGCLPRNRFCNALSGPRCCSGLRCRELSIWASRCL |
| SEQ ID NO: 911 | GNYCLRGRCLPGGRRCCNGRPCECFARICSCRPR |
| SEQ ID NO: 912 | TVRCGGCNRRCCPGGCRSGRCINGRCQCY |
| SEQ ID NO: 913 | GCMREYCAGQCRGRVSQDYCLRHCRCIPR |
| SEQ ID NO: 914 | ACLGFGERCNPSNDRCCRSSSLVCSQRHRWCRYG |
| SEQ ID NO: 915 | RGGCLPHNRFCNALSGPRCCSGLRCRELSIRDSRCLG |
| SEQ ID NO: 916 | RGGCLPRNRFCNPSSGPRCCSGLTCRELNIWASRCL |
| SEQ ID NO: 917 | QRSCARPGDMCMGIRCCDGQCGCNRGTGRCFCR |
| SEQ ID NO: 918 | ARGCADAYRSCNHPRTCCDGYNGYRRACICSGSNCRCRRS |
| SEQ ID NO: 919 | RGGCLPHNRFCNALSGPRCCSGLRCRELSIWDSRCLG |
| SEQ ID NO: 920 | RGGCLPHNRFCNALSGPRCCSGLRCRELSIYDSRCLG |
| SEQ ID NO: 921 | RGGCLPHNRFCNALSGPRCCSRLRCRELSIWDSRCLG |
| SEQ ID NO: 922 | RGGCLPHNRFCNALTGPRCCSRLRCRELSIWDSICLG |
| SEQ ID NO: 923 | SCADAYKSCDSLRCCNNRTCMCSMIGTNCTCRRR |
| SEQ ID NO: 924 | ERRCLPAGRTCVRGPMRVPCCGSCSQNRCT |
| SEQ ID NO: 925 | LCSREGEFCYRLRRCCAGFYCRAFVLHCYRN |
| SEQ ID NO: 926 | ACGSCRRRCRGSGRCINGRCRCY |
| SEQ ID NO: 927 | ACGSCRRRCRGPGRCINGRCRCY |
| SEQ ID NO: 928 | ACQGYMRRCGRDRPPCCRRLECSRTWRWCVWN |
| SEQ ID NO: 929 | GRYCQRWMWTCDSRRACCEGLRCRLWCRRI |
| SEQ ID NO: 930 | NARCRGSPECLPRCREAIGRAAGRCMNGRCRCYP |

TABLE 51-continued

Exemplary Amino Acid Sequences

| SEQ ID NO: | Amino Acid Sequence |
|---|---|
| SEQ ID NO: 931 | NVRCRGSRECLPACRAAVGRAAGRCMNGRCRCYP |
| SEQ ID NO: 932 | NVRCRGSPECLPRCREAIGRSAGRCMNGRCRCYP |
| SEQ ID NO: 933 | NARCRGSPECLPRCRQAIGRAAGRCMNGRCRCYP |
| SEQ ID NO: 934 | RGYCAERGIRCHNIHCCSGLTCRCRGSSCVCRR |
| SEQ ID NO: 935 | ERGCRLTFWRCRNRRECCGWNACALGICMPR |
| SEQ ID NO: 936 | RRRCIARDYGRCRWGGTPCCRGRGCICSIMGTNCECRPR |
| SEQ ID NO: 937 | GCRLTFWRCRNRRECCGWNACALGICMPR |
| SEQ ID NO: 938 | ACRGLFVTCTPGRDECCPNHVCSSRHRWCRYR |
| SEQ ID NO: 939 | IACAPRGLLCFRDRECCRGLTCRGRFVNTWPTFCLV |
| SEQ ID NO: 940 | ACAGLYRRCGRGVNTCCENRPCRCDLAMGNCICRRR |
| SEQ ID NO: 941 | FTCAISCDIRVNGRPCRGSGERRCSGGWSCRFNVCVRV |
| SEQ ID NO: 942 | GFCAQRGIRCHDIHCCTNLRCVREGSNRVCRRA |
| SEQ ID NO: 943 | CARRRNWCGRNEDCCCPMRCIYAWYNQQGSCQSTITGLFRRC |
| SEQ ID NO: 944 | YCQRWMWTCDSARRCCEGLVCRLWCRRI |
| SEQ ID NO: 945 | RGGCLPHNRFCNALSGPRCCSGLRCRELTIWNTRCLE |
| SEQ ID NO: 946 | NVRCTGSRQCLPACRAAVGRAAGRCMNGRCRCYT |
| SEQ ID NO: 947 | QRSCARPGEMCMRIRCCDGQCGCNRGTGRCFCR |
| SEQ ID NO: 948 | GCIPRHRRCTWSGPRCCNNISCHCNISGTLCRCRPG |
| SEQ ID NO: 949 | NYCVARRCRPGGRQCCSGRPCACVGRVCRCPRD |
| SEQ ID NO: 950 | ERGCSGAYRRCSSSQRCCEGRPCVCSAINSNCRCRRT |
| SEQ ID NO: 951 | QRSCARPGEMCMGIRCCDGQCGCNRGTGRCFCR |
| SEQ ID NO: 952 | RRGCFREGRWCPRSAPCCAPLRCRGPSIRQQRCVRE |
| SEQ ID NO: 953 | TVRCGGCNRRCCAGGCRSGRCINGRCQCYGR |
| SEQ ID NO: 954 | ERRCEPSGRPCRPLMRIPCCGSCVRGRCA |
| SEQ ID NO: 955 | RGGCLPRNRFCNPSSGPRCCSGLTCRELNIWANRCL |
| SEQ ID NO: 956 | CARRRNWCGRNEDCCCPMRCIYAWYNQQGSCQTTITGLFRRC |
| SEQ ID NO: 957 | VRIPVSCRHSGQCLRPCRDAGMRTGRCMNGRCDCTPR |
| SEQ ID NO: 958 | QKILSNRCNNSSECIPHCIRIFGTRAAKCINRKCYCYP |
| SEQ ID NO: 959 | AVCNLKRCQLSCRSLGLLGKCIGDKCECVKHG |
| SEQ ID NO: 960 | ISIGIRCSPSIDLCEGQCRIRRYFTGYCSGDTCHCSG |
| SEQ ID NO: 961 | GDCLPHLRRCRENNDCCSRRCRRRGANPERRCR |
| SEQ ID NO: 962 | SCEPGRTFRDRCNTCKCGADGRSAACTLRACPNQ |
| SEQ ID NO: 963 | GDCLPHLKRCKADNDCCGKKCKRRGTNAEKRCR |
| SEQ ID NO: 964 | GDCLPHLKRCKENNDCCSKKCKRRGTNPEKRCR |
| SEQ ID NO: 965 | KDCLKKLKLCKENKDCCSKSCKRRGTNIEKRCR |
| SEQ ID NO: 966 | GDCLPHLKRCKENNDCCSKKCKRRGANPEKRCR |
| SEQ ID NO: 967 | VFINVKCRGSPECLPKCKEAIGKSAGKCMNGKCKCYP |
| SEQ ID NO: 968 | VFINAKCRGSPECLPKCKEAIGKAAGKCMNGKCKCYP |

TABLE 51-continued

Exemplary Amino Acid Sequences

| SEQ ID NO: | Amino Acid Sequence |
|---|---|
| SEQ ID NO: 969 | VIINVKCKISRQCLEPCKKAGMRFGKCMNGKCHCTP |
| SEQ ID NO: 970 | VPTDVKCRGSPQCIQPCKDAGMRFGKCMNGKCHCTP |
| SEQ ID NO: 971 | VRIPVSCKHSGQCLKPCKDAGMRFGKCMNGKCDCTP |
| SEQ ID NO: 972 | VRIPVSCRHSGQCLRPCRDAGMRFGRCMNGRCDCTP |
| SEQ ID NO: 973 | TNVSCTTSKECWSVCQRLHNTSRGKCMNKKCRC |
| SEQ ID NO: 974 | NVKCTGSKQCLPACKAAVGKAAGKCMNGKCKC |
| SEQ ID NO: 975 | GVPINVRCRGSRDCLDPCRGAGERHGRCGNSRCHCTP |
| SEQ ID NO: 976 | VRIPVSCRHSGQCLRPCRDAGERHGRCGGGRCDCTPR |
| SEQ ID NO: 977 | QVQTNVRCQGGSCGSVCRREGGGAGGGCGNGRCGCYRN |
| SEQ ID NO: 978 | IKCSESYQCFPVCKSRFGKTNGRCVNGFCDCF |
| SEQ ID NO: 979 | VKCSSPQQCLKPCKAAFGISAGgKCINGKCKCY |
| SEQ ID NO: 980 | VSCSASSQCWPVCKKLFGTYRGKCMNSKCRCY |
| SEQ ID NO: 981 | ESCTASNQCWSICKRLHNTNRGKCMNKKCRCY |
| SEQ ID NO: 982 | VSCTTSKECWSVCEKLYNTSRGKCMNKKCRCY |
| SEQ ID NO: 983 | MRCKSSKECLVKCKQATGRPNGKCMNRKCKCY |
| SEQ ID NO: 984 | IKCTLSKDCYSPCKKETGCPRAKCINRNCKCY |
| SEQ ID NO: 985 | IRCSGSRDCYSPCMKQTGCPNAKCINKSCKCY |
| SEQ ID NO: 986 | IRCSGTRECYAPCQKLTGCLNAKCMNKACKCY |
| SEQ ID NO: 987 | ISCTNPKQCYPHCKKETGYPNAKCMNRKCKCF |
| SEQ ID NO: 988 | ASCRTPKDCADPCRKETGCPYGKCMNRKCKCN |
| SEQ ID NO: 989 | TSCISPKQCTEPCRAKGCKHGKCMNRKCHCM |
| SEQ ID NO: 990 | KECTGPQHCTNFCRKN-KCTHGKCMNRKCKCF |
| SEQ ID NO: 991 | IKCRTPKDCADPCRKQTGCPHAKCMNKTCRCH |
| SEQ ID NO: 992 | VKCTTSKECWPPCKAATGKAAGKCMNKKCKCQ |
| SEQ ID NO: 993 | LECGASRECYDPCFKAFGRAHGKCMNNKCRCY |
| SEQ ID NO: 994 | EKCFATSQCWTPCKKAIGSLQSKCMNGKCKCY |
| SEQ ID NO: 995 | VRCYASRECWEPCRRVTGSAQAKCQNNQCRCY |
| SEQ ID NO: 996 | VKCSASRECWVACKKVTGSGQGKCQNNQCRCY |
| SEQ ID NO: 997 | VKCISSQECWIACKKVTGRFEGKCQNRQCRCY |
| SEQ ID NO: 998 | VRCYDSRQCWIACKKVTGSTQGKCQNKQCRCY |
| SEQ ID NO: 999 | VDCTVSKECWAPCKAAFGVDRGKCMGKKCKCY |
| SEQ ID NO: 1000 | AKCRGSPECLPKCKEAIGKAAGKCMNGKCKCY |
| SEQ ID NO: 1001 | KKCQGGSCASVCRRVIGVAAGKCINGRCVCY |
| SEQ ID NO: 1002 | KKCSNTSQCYKTCEKVVGVAAGKCMNGKCICY |
| SEQ ID NO: 1003 | VKCSGSSKCVKICIDRYNTRGAKCINGRCTCY |
| SEQ ID NO: 1004 | NRCNNSSECIPHCIRIFGTRAAKCINRKCYCY |
| SEQ ID NO: 1005 | KECNGSSECYSHCEGITGKRSGKCINKKCYCY |
| SEQ ID NO: 1006 | AFCNLRRCELSCRSLGLLGKCIGEECKCV |

TABLE 51-continued

Exemplary Amino Acid Sequences

| SEQ ID NO: | Amino Acid Sequence |
|---|---|
| SEQ ID NO: 1007 | AVCNLKRCQLSCRSLGLLGKCIGDKCECV |
| SEQ ID NO: 1008 | AACYSS-DCRVKCVAMGFSSGKCINSKCKCY |
| SEQ ID NO: 1009 | AICATDADCSRKCPGNPPCRNGFCACT |
| SEQ ID NO: 1010 | TECQIKNDCQRYCQSVKECKYGKCYCN |
| SEQ ID NO: 1011 | TQCQSVRDCQQYCLTPDRCSYGTCYCK |
| SEQ ID NO: 1012 | VSCRYGSDCAEPCKRLKCLLPSKCINGKCTCY |
| SEQ ID NO: 1013 | IKCRYPADCHIMCRKVTGRAEGKCMNGKCTCY |
| SEQ ID NO: 1014 | IKCSSSSSCYEPCRGVTGRAHGKCMNGRCTCY |
| SEQ ID NO: 1015 | VKCTGSKQCLPACKAAVGKAAGKCMNGKCKCY |
| SEQ ID NO: 1016 | VSCKHSGQCIKPCKDA-GMRFGKCMNRKCDCT |
| SEQ ID NO: 1017 | VKCRGSPQCIQPCRDA-GMRFGKCMNGKCHCT |
| SEQ ID NO: 1018 | VKCTSPKQCLPPCKAQFGIRAGAKCMNGKCKCY |
| SEQ ID NO: 1019 | VKCTSPKQCSKPCKELYGSSAGAKCMNGKCKCY |
| SEQ ID NO: 1020 | VKCTSPKQCLPPCKEIYGRHAGAKCMNGKCHCS |
| SEQ ID NO: 1021 | VKCTGSKQCWPVCKQMFGKPNGKCMNGKCRCY |
| SEQ ID NO: 1022 | VKCRGSRDCLDPCKKAGMRFGKCINSKCHCT |
| SEQ ID NO: 1023 | VRCVTDDDCFRKCPGNPSCKRGFCACK |
| SEQ ID NO: 1024 | VPCNNSRPCVPVCIREVNNKNGKCSNGKCLCY |
| SEQ ID NO: 1025 | VPINVKCRGSRDCLDPCKKAGMRFGKCINSKCHCTP |
| SEQ ID NO: 1026 | VQTNVKCQGGSCASVCRREIGVAAGKCINGKCVCYRN |
| SEQ ID NO: 1027 | AEIIRCSGTRECYAPCQKLTGCLNAKCMNKACKCYGCV |
| SEQ ID NO: 1028 | RPTDIKCSASYQCFPVCKSRFGKTNGRCVNGLCDCF |
| SEQ ID NO: 1029 | QFTDVKCTGSKQCWPVCKQMFGKPNGKCMNGKCRCYS |
| SEQ ID NO: 1030 | VGINVKCKHSRQCLKPCKDAGMRFGKCTNGKCHCTPK |
| SEQ ID NO: 1031 | VVIGQRCYRSPDCYSACKKLVGKATGKCTNGRCDC |
| SEQ ID NO: 1032 | NFKVEGACSKPCRKYCIDKGARNGKCINGRCHCYY |
| SEQ ID NO: 1033 | QIDTNVKCSGSSKCVKICIDRYNTRGAKCINGRCTCYP |
| SEQ ID NO: 1034 | GVPISVRCRGSRDCLEPCRRAGTRFGRCINGRCHCTP |
| SEQ ID NO: 1035 | GVPISVRCRGSRDCLEPCRRAGTRFGRCIQSRCHCTP |
| SEQ ID NO: 1036 | GVPISVRCRGSRDCLEPCRRAGTRFGRCINRRCHCTP |
| SEQ ID NO: 1037 | GVPINVRCRGSRDCLEPCRRAGTRFGRCINSRCHCTP |
| SEQ ID NO: 1038 | GVPINVRCRGSRDCLEPCRRAGTRFGRCIQSRCHCTP |
| SEQ ID NO: 1039 | GVPINVRCRGSRDCLEPCRRAGTRFGRCIQSRCHCYP |
| SEQ ID NO: 1040 | GVPINVRCRGSRDCYEPCRRAGTRFGRCIQSRCHCTP |
| SEQ ID NO: 1041 | GVPINVRCRGSRDCLEPCRRAGTRFGRCIQSRCYCTP |
| SEQ ID NO: 1042 | GVPISVRCRGSRDCLEPCRRAGTRFGRCIQSRCHCYP |
| SEQ ID NO: 1043 | GVPISVRCRGSRDCYEPCRRAGTRFGRCIQSRCHCTP |
| SEQ ID NO: 1044 | GVPISVRCRGSRDCLEPCRRAGTRFGRCIQSRCYCTP |

TABLE 51-continued

Exemplary Amino Acid Sequences

| SEQ ID NO: | Amino Acid Sequence |
|---|---|
| SEQ ID NO: 1045 | GVPINVRCRGSRDCLEPCRRAGTRFGRCIASRCHCYP |
| SEQ ID NO: 1046 | GVPINVRCRGSRDCLEPCRRAGTRFGRCISSRCHCYP |
| SEQ ID NO: 1047 | GVPINVRCRGSRDCLEPCRRAGTRFGRCITSRCHCYP |
| SEQ ID NO: 1048 | GVPINVRCRGSRDCLEPCRRAGTRFGRCINSRCHCYP |

In any of SEQ ID NO: 485-SEQ ID NO: 1048 or fragment thereof, any one or more K residues can be replaced by an R residue or an A residue, any one or more R residues can be replaced by a K residue or an A residue, any one or more A residues can be replaced by a K residue or an R residue, all K residues can be replaced by R residues or A residues, all but one K residue can be replaced by R or A residues, all but two K residues can be replaced by R residues or A residues, or in any combination thereof. In any of SEQ ID NO: 485-SEQ ID NO: 1048 or any fragment thereof, any one or more M residues can be replaced by any one of I, L, or V residues, any one or more L residues can be replaced by any one of V, I, or M residues, any one or more I residues can be replaced by any one of M, L, or V residues, or any one or more V residues can be replaced by any one of I, L, or M residues. In any embodiment, at least one of the amino acids alone or in combination can be interchanged in the peptides or peptide fragments as follows: K/R, M/I/L/V, G/A, S/T, Q/N, and D/E wherein each letter is each individually any amino acid or amino acid analogue. In some instances, the peptide can contain only one lysine residue, or no lysine residue. In any of SEQ ID NO: 485-SEQ ID NO: 1048 or fragment thereof, any amino acid can be replaced with citrulline. In any of SEQ ID NO: 485-SEQ ID NO: 1048 or any fragment thereof, X can independently be any number of any amino acid or no amino acid. In some cases, a peptide can include the first two N-terminal amino acids GS, as with peptides of SEQ ID NO: 485-SEQ ID NO: 758, or such N-terminal amino acids (GS) can be substituted by any other one or two amino acids. In other cases, a peptide does not include the first two N-terminal amino acids GS, as with peptides of SEQ ID NO: 759-SEQ ID NO: 1048. In some cases, the N-terminus of the peptide is blocked, such as by an acetyl group; in other instances, the C-terminus of the peptide is blocked, such as by an amide group.

In some instances, the peptide is any one of SEQ ID NO: 485-SEQ ID NO: 1048 or a functional fragment thereof. In other embodiments, the peptide of the disclosure further comprises a peptide with 100%, 99%, 97%, 95%, 90%, 85%, or 80% homology to any one of SEQ ID NO: 485-SEQ ID NO: 1048. In further embodiments, the peptide fragment comprises a contiguous fragment of any one of SEQ ID NO: 485-SEQ ID NO: 1048 that is at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46 residues long, wherein the peptide fragment is selected from any portion of the peptide. In some embodiments, such peptide fragments contact the cartilage and exhibit properties of those described herein for peptide and peptide-active agent conjugates.

The peptides of the present disclosure can further comprise negative amino acid residues. In some cases, the peptide has 2 or fewer negative amino acid residues. In other cases, the peptide has 4 or fewer negative amino acid residues, 3 or fewer negative amino acid residues, or 1 or fewer negative amino acid residues. The negative amino acid residues can be selected from any negative charged amino acid residues. The negative amino acid residues can be selected from either E or D, or a combination of both E and D.

The peptides of the present disclosure can further comprise basic amino acid residues. In some embodiments, basic residues are added to the peptide sequence to increase the charge at physiological pH. The added basic residues can be any basic amino acid. The added basic residues can be selected from K or R, or a combination of K or R.

In some embodiments, the peptide has a charge distribution comprising an acidic region and a basic region. An acidic region can be a nub. A nub is a portion of a peptide extending out of the peptide's three-dimensional structure. A basic region can be a patch. A patch is a portion of a peptide that does not designate any specific topology characteristic of the peptide's three-dimensional structure. In further embodiments, a cystine-dense peptide can be 6 or more basic residues and 2 or fewer acidic residues.

The peptides of the present disclosure can further comprise positively charged amino acid residues. In some cases, the peptide has at least 2 positively charged residues. In other cases, the peptide has at least 3 positively charged residues, at least 4 positively charged residues, at least 5 positively charged residues, at least 6 positively charged residues, at least 7 positively charged residues, at least 8 positively charged residues or at least 9 positively charged residues. The positively charged residues can be selected from any positively charged amino acid residues. The positively charged residues can be selected from either K or R, or a combination of K and R.

In addition, the peptides herein can comprise a 4-19 amino acid residue fragment of any of the above sequences containing at least 2 cysteine residues, and at least 2 or 3 positively charged amino acid residues (for example, arginine, lysine or histidine, or any combination of arginine, lysine or histidine). In other embodiments, the peptides herein is a 20-70 amino acid residue fragment of any of the above sequences containing at least 2 cysteine residues, no more than 2 basic residues, and at least 2 or 3 positively charged amino acid residues (for example, arginine, lysine or histidine, or any combination of arginine, lysine or histidine). In some embodiments, such peptide fragments contact the cartilage and exhibit properties of those described herein for peptide and peptide-active agent conjugates.

In some embodiments, the peptide contains one or more disulfide bonds and has a positive net charge at neutral pH.

At physiological pH, peptides can have a net charge, for example, of −5, −4, −3, −2, −1, 0, +1, +2, +3, +4, or +5. When the net charge is zero, the peptide can be uncharged or zwitterionic. In some instances, the peptide can have a positive charge at physiological pH. In some instances, the peptide can have a charge ≥+2 at physiological pH, ≥+3.5 at physiological pH, ≥+4.5 at physiological pH. In some embodiments, the peptide contains one or more disulfide bonds and has a positive net charge at neutral pH where the net charge can be +0.5 or less than +0.5, +1 or less than +1, +1.5 or less than +1.5, +2 or less than +2, +2.5 or less than +2.5, +3 or less than +3, +3.5 or less than +3.5, +4 or less than +4, +4.5 or less than +4.5, +5 or less than +5, +5.5 or less than +5.5, +6 or less than +6, +6.5 or less than +6.5, +7 or less than +7, +7.5 or less than +7.5, +8 or less than +8, +8.5 or less than +8.5, +9 or less than +9.5, +10 or less than +10. In some embodiments, the peptide has a negative net charge at physiological pH where the net charge can be −0.5 or less than −0.5, −1 or less than −1, −1.5 or less than −1.5, −2 or less than −2, −2.5 or less than −2.5, −3 or less than −3, −3.5 or less than −3.5, −4 or less than −4, −4.5 or less than −4.5, −5 or less than −5, −5.5 or less than −5.5, −6 or less than −6, −6.5 or less than −6.5, −7 or less than −7, −7.5 or less than −7.5, −8 or less than −8, −8.5 or less than −8.5, −9 or less than −9.5, −10 or less than −10. In some cases, the engineering of one or more mutations within a peptide yields a peptide with an altered isoelectric point, charge, surface charge, or rheology at physiological pH. Such engineering of a mutation to a peptide derived from a scorpion or spider can change the net charge of the complex, for example, by decreasing the net charge by 1, 2, 3, 4, or 5, or by increasing the net charge by 1, 2, 3, 4, or 5. In such cases, the engineered mutation may facilitate the ability of the peptide to contact the cartilage. Suitable amino acid modifications for improving the rheology and potency of a peptide can include conservative or non-conservative mutations. A peptide can comprises at most 1 amino acid mutation, at most 2 amino acid mutations, at most 3 amino acid mutations, at most 4 amino acid mutations, at most 5 amino acid mutations, at most 6 amino acid mutations, at most 7 amino acid mutations, at most 8 amino acid mutations, at most 9 amino acid mutations, at most 10 amino acid mutations, or another suitable number as compared to the sequence of the venom or toxin that the peptide is derived from. In other cases, a peptide, or a functional fragment thereof, comprises at least 1 amino acid mutation, at least 2 amino acid mutations, at least 3 amino acid mutations, at least 4 amino acid mutations, at least 5 amino acid mutations, at least 6 amino acid mutations, at least 7 amino acid mutations, at least 8 amino acid mutations, at least 9 amino acid mutations, at least 10 amino acid mutations, or another suitable number as compared to the sequence of the venom or toxin that the peptide is derived from. In some embodiments, mutations can be engineered within a peptide to provide a peptide that has a desired charge or stability at physiological pH.

Peptides can be mutated to add function or remove function. For example, peptides and peptide-conjugates of the present disclosure can be mutated to retain, remove, or add the ability to bind to ion channels, or to promote agonizing or antagonizing ion channels, such as potassium channel binding that may occur with the peptide or peptide-conjugates (e.g., the potassium channel hERG). In some instances, it can be advantageous to remove potassium channel binding from a peptide used for delivery of an active agent. Mutations can include one or more N to S, D to E, M to T, N to Q, N to A, N to S, N to T, N to L, S to G, and S to R amino acid substitutions, or one or more L to Y, H to Y, and T to Y amino acid substitutions, or any combination of thereof, depending on whether the variant is designed to retain function or to remove function of binding to the ion channel. In some embodiments the peptides and peptide-drug conjugates of the present disclosure are mutated to minimize ion channel binding in order to minimize side effects or enhance the safety either in the target tissue or systemically.

In some embodiments, charge can play a role in cartilage homing. The interaction of a peptide of this disclosure in solution and in vivo can be influenced by the isoelectric point (pI) of the peptide and/or the pH of the solution or the local environment it is in. The charge of a peptide in solution can impact the solubility of the protein as well as parameters such as biodistribution, bioavailability, and overall pharmacokinetics. Additionally, positively charged molecules can interact with negatively charged molecules. Positively charged molecules such as the peptides disclosed herein can interact and bind with negatively charged molecules such as the negatively charged extracellular matrix molecules in the cartilage including hyaluranon and aggrecan. Positively charged residues can also interact with specific regions of other proteins and molecules, such as negatively charged residues of receptors or electronegative regions of an ion channel pore on cell surfaces. As such, the pI of a peptide can influence whether a peptide of this disclosure can efficiently home to cartilage. Identifying a correlation between pI and cartilage homing can be an important strategy in identifying lead peptide candidates of the present disclosure. The pI of a peptide can be calculated using a number of different methods including the Expasy pI calculator and the Sillero method. The Expasy pI can be determined by calculating pKa values of amino acids as described in Bjellqvist et al., which were defined by examining polypeptide migration between pH 4.5 to pH 7.3 in an immobilized pH gradient gel environment with 9.2M and 9.8M urea at 15° C. or 25° C. (Bjellqvist et al. Electrophoresis. 14(10):1023-31 (1993)). The Sillero method of calculating pI can involve the solution of a polynomial equation and the individual pKas of each amino acid. This method does not use denaturing conditions (urea) (Sillero et al. 179(2): 319-35 (1989)) Using these pI calculation methods and quantifying the cartilage to blood ratio of peptide signal after administration to a subject can be a strategy for identifying a trend or correlation in charge and cartilage homing. In some embodiments, a peptide with a pI above biological pH (~pH 7.4) can exhibit efficient homing to cartilage. In some embodiments, a peptide with a pI of at least 8, at least 9, at least 10, or at least 11 can efficiently home to cartilage. In other embodiments, a peptide with a pI of 11-12 can home most efficiently to cartilage. In certain embodiments, a peptide can have a pI of about 9. In other embodiments, a peptide can have a pI of 8-10. In some embodiments, more basic peptides can home more efficiently to cartilage. In other embodiments, a high pI alone may not be sufficient to cause cartilage homing of a peptide.

In some embodiments, the tertiary structure and electrostatics of a peptide of the disclosure can impact cartilage homing. Structural analysis or analysis of charge distribution can be a strategy to predict residues important in biological function, such as cartilage homing. For example, several peptides of this disclosure that home to cartilage can be grouped into a structural class defined herein as "hitchins," and can share the properties of disulfide linkages between C1-C4, C2-C5, and C3-C6. The folding topologies of peptides linked through three disulfide linkages (C1-C4, C2-C5, and C3-C6), can be broken down into structural families based on the three-dimensional arrangement of the disulfides. Some cystine-dense peptides have the C3-C6 disulfide linkage passing through the macrocycle formed by the C1-C4 and C2-C5 disulfide linkages, hitchins have the C2-C5 disulfide linkage passing through the macrocycle formed by the C1-C4 and C3-C6 disulfide linkages, and yet other structural families have the C1-C4 disulfide linkage passing through the macrocycle formed by the C2-C5 and C3-C6 disulfide linkages. Variants of "hitchin" class peptides with preserved disulfide linkages at these cysteine residues, primary sequence identity, and/or structural homology can be a method of identifying or predicting other potential peptide candidates that can home to cartilage. Additionally, members and related members of the calcin family of peptides can also home to cartilage, despite having a distinct tertiary structure from the "hitchin" class of peptides. Calcin peptides are structurally a subset of the cystine-dense peptides, with cystine-dense disulfide connectivity and topology, but are further classified on the basis of functioning to bind and activate ryanodine receptors (RyRs). These receptors are calcium channels that act to regulate the influx and efflux of calcium in muscle (Schwartz et al. Br J Pharmacol 157(3):392-403. (2009)). Variants of the calcin family of peptides with preserved key residues can be one way to predict promising candidates that can home to cartilage. In some embodiments, structural analysis of a peptide of this disclosure can be determined by evaluating peptides for resistance to degradation in buffers with various proteases or reducing agents. Structural analysis of the distribution of charge density on the surface of a peptide can also be a strategy for predicting promising candidates that can home to cartilage. Peptides with large patches of positive surface charge (when at pH 7.5) can home to cartilage.

The NMR solution structures, x-ray crystallography, or crystal structures of related structural homologs can be used to inform mutational strategies that can improve the folding, stability, and manufacturability, while maintaining the ability of a peptide to home to cartilage. They can be used to predict the 3D pharmacophore of a group of structurally homologous scaffolds, as well as to predict possible graft regions of related proteins to create chimeras with improved properties. For example, this strategy can be used to identify critical amino acid positions and loops that can be used to design drugs with improved properties or to correct deleterious mutations that complicate folding and manufacturability for the peptides. These key amino acid positions and loops can be retained while other residues in the peptide sequences can be mutated to improve, change, remove, or otherwise modify function, homing, and activity of the peptide.

Additionally, the comparison of the primary sequences and the tertiary sequences of two or more peptides can be used to reveal sequence and 3D folding patterns that can be leveraged to improve the peptides and parse out the biological activity of these peptides. For example, comparing two different peptide scaffolds that home to cartilage can lead to the identification of conserved pharmacophores that can guide engineering strategies, such as designing variants with improved folding properties. Important pharmacophore, for example, can comprise aromatic residues or basic residues, which can be important for binding.

Improved peptides can also be engineered based upon immunogenicity information, such as immunogenicity information predicted by TEPITOPE and TEPITOPEpan. TEPITOPE is a computational approach which uses position specific scoring matrix to provide prediction rules for whether a peptide will bind to 51 different HLA-DR alleles, and TEPITOPEpan is method that uses TEPITOPE to extrapolate from HLA-DR molecules with known binding specificities to HLA-DR molecules with unknown binding specificities based on pocket similarity. For example, TEPITOPE and TEPITOPEpan can be used to determine immunogenicity of peptides that home to cartilage. Immunogenicity information can also be predicted using the program NetMHCII version 2. 3, which can determine the likelihood that a sequence might be presented as an immunogenic peptide via the major histocompatibility complex (MHC) presentation system of antigen presenting cells (APCs). (Nielson, M et al. *BMC Bioinformatics*, 8: 238 (2007); Nielsen, M. et al. *BMC Bioinformatics*, 10: 296 (2009)). This program can create an immunogenicity score by predicting the binding of a peptide to MHC alleles. Strong binding alleles and weak binding alleles in each major MHC allele group (DR, DQ, and DP) can be tallied separately. The number of peptides of a specific length within the sequence (e.g., a 'core' peptide that can be nine residues long) that are immunogenic can also be tallied. Comparison of peptides or 'core' peptides with high immunogenicity to peptides or 'core' peptides with low immunogenicity can guide engineering strategies for designing variants with decreased immunogenicity. Stronger binding peptides can be more likely to generate an immune response in patient carrying that given MHC alleles. Mutating stronger binding amino acids or peptides out of a peptide sequence can reduce the immunogenicity of the entire peptide. Another aspect of immunogenicity, in addition to whether a peptide binds to a patient's MHC allele, can be whether the patient's immune cells, such as a professional antigen presenting cells such as a macrophage, a B cell, or a dendritic cell, can process the peptide. A dendritic cell can take up a protein or peptide, and then can process a peptide, such as by cleaving to form a nine residue long peptide, which then can bind to the MHC and can be presented on the surface of the dendritic cell to the immune system's various T cells, including helper T cells and cytotoxic T cells, and thus can stimulate an immune response. The processing can involve peptide bond cleavage by enzymes and disulfide bond reduction, and thus a peptide or protein that is resistant to enzymatic cleavage and/or reduction can be resistant to processing and subsequent MHC presentation to the immune system. Therefore, having a peptide or protein that is resistant to enzymatic cleavage and/or reduction can reduce its immunogenic potential.

Furthermore, multiple sequence alignment can also be used to inform mutational strategies using previously identified sequences, and thus providing a guide to making changes that would eliminate labile residues and immunogenic regions of a peptide sequence. Peptides can be evaluated for residues of potential biochemical instability and regions of potential immunogenicity. Then, a residue that can allow for greater peptide stability at a certain location in a peptide can be identified from a multiple sequence alignment. For example, a specific residue can be identified from a multiple sequence alignment as providing greater stability for a peptide at position previously identified as a possible risk for a significant rate of deamidation, cleavage, degradation, oxidation, hydrolysis, isomerization, disulfide exchange, racemization, beta elimination, or aggregation. This information can then be used to create peptides with greater stability or reduced immunogenicity.

In addition to utilizing co-crystal x-ray structures, NMR solution structures, and mutagenesis studies, a multiple alignment of peptide sequences can be used to identify specific amino acids or regions of high conservation that indicate an important interaction with a target or receptor (e.g., binding to a potassium channel protein) or are important for folding and structure or other properties. Once the conserved amino acid or region is identified, then amino acids replacements can be determined that maintain the important properties of the peptide, such as maintenance of the structure, reduction in immunogenicity, reduction in binding to an ion channel protein, increased stability, or any combination of thereof. The multiple sequence alignment can also identify possible locations to add a tyrosine or tryptophan residue for spectrophotometric reporting. Incorporation of aromatic amino acids such as Tyrosine or Tryptophan into a peptide such as SEQ ID NO: 592, which otherwise contains only amino acids of low UV absorbance at 280 nm, can be analytically advantageous. Tyrosine and Tryptophan amino acids contain aromatic ring structures. These residues have distinct absorption and emission wavelengths and good quantum yields, as shown in TABLE 52, not present in other amino acids. Both Tyrosine and Tryptophan can provide a good 'handle' for analytical detection of a peptide in solution since UV absorbance in the 250-300 nm range and peptide fluorescence is specific for these aromatic molecules. While detection of a peptide such as SEQ ID NO: 592 relies on the absorbance of the peptide bond at 220 nm, where many other materials including minor impurities in solvents also often contribute to signal, the absorbance and fluorescence properties of Tryptophan and Tyrosine containing peptides can provide for a significantly more selective and sensitive detection. Thus incorporating an aromatic amino acid can create peptides better suited for concentration and purity measurements, which can be useful during analytics, process development, manufacturing, and other drug development and drug manufacturing activities. Incorporation can be achieved either through substitutions of one or more amino acids in the peptide to Tyr and/or Trp, insertion of Tyr and/or Trp into the peptide, or via addition of Tyr and/or Trp to the N-terminus or C-terminus of the peptide.

TABLE 52

Absorbance and Fluorescence Characteristics of Tryptophan and Tyrosine.

| Amino Acid | Absorbance | | Fluorescence | |
|---|---|---|---|---|
| | Wavelength (nm) | Absorbtivity (M * cm)$^{-1}$ | Wavelength (nm) | Quantum Yield |
| Tryptophan | 280 | 5,600 | 348 | 0.20 |
| Tyrosine | 274 | 1,400 | 303 | 0.14 |

A peptide of this disclosure can bind to chloride, potassium, or sodium channels. The peptide can also bind to calcium channels. The peptide can block potassium channels and/or sodium channels. The peptide can block calcium channels. In some embodiments, the peptide can activate any one or more of such channels. In some embodiments, the peptide can block any one or more of such channels. In some embodiments, the peptide cannot interact with any of such channels or can be mutated to reduce or remove binding to any such channels. In still other embodiments, the peptide can be a potassium channel agonist, a potassium channel antagonist, a portion of a potassium channel, a sodium channel agonist, a sodium channel antagonist, a chloride channel agonist, a chloride channel antagonist, a calcium channel agonist, a calcium channel antagonist, a hadrucalcin, a theraphotoxin, a huwentoxin, a kaliotoxin, a cobatoxin or a lectin. In some embodiments, the lectin can be SHL-Ib2. In some embodiments, the peptide can interact with, binds, inhibits, inactivates, or alters expression of ion channels or chloride channels. In some embodiments, the peptide can interact with an Nav1.7 ion channel. In some embodiments, the peptide can interact with a Kv 1.3 ion channel. In still other embodiments, the peptide interacts with proteases, matrix metalloproteinase, inhibits cancer cell migration or metastases, has antimicrobial activity, or has antitumor activity. In addition to acting on matrix metalloproteinases, the peptide can interact with other possible proteases (e.g., elastases). In some embodiments, a peptide of this disclosure can bind to multidrug resistance transporters. Peptide and peptide drug conjugate binding to and blocking multidrug resistance transporters can be used to treat bacterial infections or cancers of the joint and/or bone.

In some embodiments, the peptide has other therapeutic effects on the cartilage or structures thereof or nearby. Beta defensin expression in articular cartilage can be correlated with immunomodulatory functions as we well as osteoarthritis, autoimmune rheumatic disorders such as systemic lupus erythematosus and rheumatoid arthritis (Vordenbiumen and Schneider 2011, Varoga 2004 and Varoga 2005). In some embodiments, the peptides or their mutants inhibit beta defensins, supplement beta defensins, are competitive inhibitors of beta defensins, active or block activation of beta defensin targets, and are used as immune modulators, or to treat autoimmune, arthritis, infections, and other articular disorders.

The present disclosure can also encompass multimers of the various peptides described herein. Examples of multimers include dimers, trimers, tetramers, pentamers, hexamers, heptamers, and so on. A multimer can be a homomer formed from a plurality of identical subunits or a heteromer formed from a plurality of different subunits. In some embodiments, a peptide of the present disclosure is arranged in a multimeric structure with at least one other peptide, or two, three, four, five, six, seven, eight, nine, ten, or more other peptides. In certain embodiments, the peptides of a multimeric structure each have the same sequence. In alternative embodiments, some or all of the peptides of a multimeric structure have different sequences.

The present disclosure further includes peptide scaffolds that, e.g., can be used as a starting point for generating additional peptides. In some embodiments, these scaffolds can be derived from a variety of cystine-dense peptides. Some suitable peptides for scaffolds can include, but are not limited to, chlorotoxin, brazzein, circulin, stecrisp, hanatoxin, midkine, hefutoxin, potato carboxypeptidase inhibitor, bubble protein, attractin, α-GI, α-GID, μ-PIIIA, ω-MVIIA, ω-CVID, χ-MrIA, ρ-TIA, conantokin G, contulakin G, GsMTx4, margatoxin, shK, toxin K, chymotrypsin inhibitor (CTI), and EGF epiregulin core.

In some embodiments, the peptide sequences of the disclosure are flanked by additional amino acids. One or more additional amino acids can, for example, confer a desired in vivo charge, isoelectric point, chemical conjugation site, stability, or physiologic property to a peptide.

Identifying sequence homology can be important for determining key residues that preserve cartilage homing function. For example, in some embodiments identification of conserved positively charged residues can be important in preserving cartilage homing in any homologous variants that are made. In other embodiments, identification of basic or aromatic dyads, can be important in preserving interaction and activity with Kv ion channels in homologous variants.

Two or more peptides can share a degree of homology and share similar properties in vivo. For instance, a peptide can share a degree of homology with a peptide of the present disclosure. In some cases, a peptide of the disclosure can have up to about 20% pairwise homology, up to about 25% pairwise homology, up to about 30% pairwise homology, up to about 35% pairwise homology, up to about 40% pairwise homology, up to about 45% pairwise homology, up to about 50% pairwise homology, up to about 55% pairwise homology, up to about 60% pairwise homology, up to about 65% pairwise homology, up to about 70% pairwise homology, up to about 75% pairwise homology, up to about 80% pairwise homology, up to about 85% pairwise homology, up to about 90% pairwise homology, up to about 95% pairwise homology, up to about 96% pairwise homology, up to about 97% pairwise homology, up to about 98% pairwise homology, up to about 99% pairwise homology, up to about 99.5% pairwise homology, or up to about 99.9% pairwise homology with a second peptide. In some cases, a peptide of the disclosure can have at least about 20% pairwise homology, at least about 25% pairwise homology, at least about 30% pairwise homology, at least about 35% pairwise homology, at least about 40% pairwise homology, at least about 45% pairwise homology, at least about 50% pairwise homology, at least about 55% pairwise homology, at least about 60% pairwise homology, at least about 65% pairwise homology, at least about 70% pairwise homology, at least about 75% pairwise homology, at least about 80% pairwise homology, at least about 85% pairwise homology, at least about 90% pairwise homology, at least about 95% pairwise homology, at least about 96% pairwise homology, at least about 97% pairwise homology, at least about 98% pairwise homology, at least about 99% pairwise homology, at least about 99.5% pairwise homology, at least about 99.9% pairwise homology with a second peptide. Various methods and software programs can be used to determine the homology between two or more peptides, such as NCBI BLAST, Clustal W, MAFFT, Clustal Omega, AlignMe, Praline, or another suitable method or algorithm.

In still other instances, the variant nucleic acid molecules of a peptide of any one of SEQ ID NO: 508-SEQ ID NO: 758 or SEQ ID NO: 798-SEQ ID NO: 1048 can be identified by either a determination of the sequence identity or homology of the encoded peptide amino acid sequence with the amino acid sequence of any one of SEQ ID NO: 508-SEQ ID NO: 758, SEQ ID NO: 798-SEQ ID NO: 1048, or by a nucleic acid hybridization assay. Such peptide variants can include nucleic acid molecules (1) that remain hybridized with a nucleic acid molecule having the nucleotide sequence of any one of SEQ ID NO: 508-SEQ ID NO: 758 or SEQ ID NO: 798-SEQ ID NO: 1048 (or any complement of the previous sequences) under stringent washing conditions, in which the wash stringency is equivalent to 0.5×-2×SSC with 0.1% SDS at 55-65° C., and (2) that encode a peptide having at least 70%, at least 80%, at least 90%, at least 95% or greater than 95% sequence identity or homology to the amino acid sequence of any one SEQ ID NO: 508-SEQ ID NO: 758 or SEQ ID NO: 798-SEQ ID NO: 1048. Alternatively, peptide variants of any one SEQ ID NO: 508-SEQ ID NO: 758 or SEQ ID NO: 798-SEQ ID NO: 1048 can be characterized as nucleic acid molecules (1) that remain hybridized with a nucleic acid molecule having the nucleotide sequence of any one SEQ ID NO: 508-SEQ ID NO: 758 or SEQ ID NO: 798-SEQ ID NO: 1048 (or any complement of the previous sequences) under highly stringent washing conditions, in which the wash stringency is equivalent to 0.1×-0.2×SSC with 0.1% SDS at 50-65° C., and (2) that encode a peptide having at least 70%, at least 80%, at least 90%, at least 95% or greater than 95% sequence identity or homology to the amino acid sequence of any one of SEQ ID NO: 508-SEQ ID NO: 758 or SEQ ID NO: 798-SEQ ID NO: 1048.

Percent sequence identity or homology can be determined by conventional methods. See, for example, Altschul et al., Bull. Math. Bio. 48:603 (1986), and Henikoff and Henikoff, Proc. Natl. Acad. Sci. USA 89:10915 (1992). Briefly, two amino acid sequences are aligned to optimize the alignment scores using a gap opening penalty of 10, a gap extension penalty of 1, and the "BLOSUM62" scoring matrix of Henikoff and Henikoff (Id.). The sequence identity or homology is then calculated as: ([Total number of identical matches]/[length of the longer sequence plus the number of gaps introduced into the longer sequence in order to align the two sequences])(100).

Additionally, there are many established algorithms available to align two amino acid sequences. For example, the "FASTA" similarity search algorithm of Pearson and Lipman is a suitable protein alignment method for examining the level of sequence identity or homology shared by an amino acid sequence of a peptide disclosed herein and the amino acid sequence of a peptide variant. The FASTA algorithm is described by Pearson and Lipman, Proc. Natl Acad. Sci. USA 85:2444 (1988), and by Pearson, Meth. Enzymol. 183:63 (1990). Briefly, FASTA first characterizes sequence similarity by identifying regions shared by the query sequence (e.g., SEQ ID NO: 485) and a test sequence that has either the highest density of identities (if the ktup variable is 1) or pairs of identities (if ktup=2), without considering conservative amino acid substitutions, insertions, or deletions. The ten regions with the highest density of identities are then rescored by comparing the similarity of all paired amino acids using an amino acid substitution matrix, and the ends of the regions are "trimmed" to include only those residues that contribute to the highest score. If there are several regions with scores greater than the "cutoff" value (calculated by a predetermined formula based upon the length of the sequence and the ktup value), then the trimmed initial regions are examined to determine whether the regions can be joined to form an approximate alignment with gaps. Finally, the highest scoring regions of the two amino acid sequences are aligned using a modification of the Needleman-Wunsch-Sellers algorithm (Needleman and Wunsch, J. Mol. Biol. 48:444 (1970); Sellers, Siam J. Appl. Math. 26:787 (1974)), which allows for amino acid insertions and deletions. Illustrative parameters for FASTA analysis are: ktup=1, gap opening penalty=10, gap extension penalty=1, and substitution matrix=BLOSUM62. These parameters can be introduced into a FASTA program by modifying the scoring matrix file ("SMATRIX"), as explained in Appendix 2 of Pearson, Meth. Enzymol. 183:63 (1990).

FASTA can also be used to determine the sequence identity or homology of nucleic acid molecules using a ratio as disclosed above. For nucleotide sequence comparisons, the ktup value can range between one to six, preferably from three to six, most preferably three, with other parameters set as described above.

Some examples of common amino acids that are a "conservative amino acid substitution" are illustrated by a substitution among amino acids within each of the following groups: (1) glycine, alanine, valine, leucine, and isoleucine, (2) phenylalanine, tyrosine, and tryptophan, (3) serine and threonine, (4) aspartate and glutamate, (5) glutamine and asparagine, and (6) lysine, arginine and histidine. The BLO- SUM62 table is an amino acid substitution matrix derived from about 2,000 local multiple alignments of protein sequence segments, representing highly conserved regions of more than 500 groups of related proteins (Henikoff and Henikoff, *Proc. Nat'l Acad. Sci. USA* 89:10915 (1992)). Accordingly, the BLOSUM62 substitution frequencies can be used to define conservative amino acid substitutions that may be introduced into the amino acid sequences of the present invention. Although it is possible to design amino acid substitutions based solely upon chemical properties (as discussed above), the language "conservative amino acid substitution" preferably refers to a substitution represented by a BLOSUM62 value of greater than −1. For example, an amino acid substitution is conservative if the substitution is characterized by a BLOSUM62 value of 0, 1, 2, or 3. According to this system, preferred conservative amino acid substitutions are characterized by a BLOSUM62 value of at least 1 (e.g., 1, 2 or 3), while more preferred conservative amino acid substitutions are characterized by a BLOSUM62 value of at least 2 (e.g., 2 or 3).

Determination of amino acid residues that are within regions or domains that are critical to maintaining structural integrity can be determined. Within these regions one can determine specific residues that can be more or less tolerant of change and maintain the overall tertiary structure of the molecule. Methods for analyzing sequence structure include, but are not limited to, alignment of multiple sequences with high amino acid or nucleotide identity or homology and computer analysis using available software (e.g., the Insight II.® viewer and homology modeling tools; MSI, San Diego, Calif.), secondary structure propensities, binary patterns, complementary packing and buried polar interactions (Barton, G. J., *Current Opin. Struct. Biol.* 5:372-6 (1995) and Cordes, M. H. et al., *Current Opin. Struct. Biol.* 6:3-10 (1996)). In general, when designing modifications to molecules or identifying specific fragments determination of structure can typically be accompanied by evaluating activity of modified molecules.

Pairwise sequence alignment is used to identify regions of similarity that may indicate functional, structural and/or evolutionary relationships between two biological sequences (protein or nucleic acid). By contrast, multiple sequence alignment (MSA) is the alignment of three or more biological sequences. From the output of MSA applications, homology can be inferred and the evolutionary relationship between the sequences assessed. One of skill in the art would recognize as used herein, "sequence homology" and "sequence identity" and "percent (%) sequence identity" and "percent (%) sequence homology" have been used interchangeably to mean the sequence relatedness or variation, as appropriate, to a reference polynucleotide or amino acid sequence.

Chemical Modifications

A peptide can be chemically modified one or more of a variety of ways. In some embodiments, the peptide can be mutated to add function, delete function, or modify the in vivo behavior. One or more loops between the disulfide linkages can be modified or replaced to include active elements from other peptides (such as described in Moore and Cochran, Methods in Enzymology, 503, p. 223-251, 2012). Amino acids can also be mutated, such as to increase half-life or bioavailability, modify, add or delete binding behavior in vivo, add new targeting function, modify surface charge and hydrophobicity, or allow conjugation sites. N-methylation is one example of methylation that can occur in a peptide of the disclosure. In some embodiments, the peptide can be modified by methylation on free amines. For example, full methylation can be accomplished through the use of reductive methylation with formaldehyde and sodium cyanoborohydride.

A chemical modification can, for instance, extend the terminal half-life, the absorption half-life, the distribution half-life of a peptide, change the biodistribution or pharmacokinetic profile, or the modification itself can be useful to provide viscosupplementation to a joint. A chemical modification can comprise a polymer, a polyether, polyethylene glycol, a biopolymer, a polyamino acid, a fatty acid, a dendrimer, an Fc region, a simple saturated carbon chain such as palmitate or myristolate, sugars, hyaluronic acid, or albumin. The chemical modification of a peptide with an Fc region can be a fusion Fc-peptide. A polyamino acid can include, for example, a polyamino acid sequence with repeated single amino acids (e.g., polyglycine), and a polyamino acid sequence with mixed polyamino acid sequences (e.g., gly-ala-gly-ala (SEQ ID NO: 1052)) that can or cannot follow a pattern, or any combination of the foregoing.

In some embodiments, the peptides of the present disclosure may be modified such that the modification increases the stability and/or the half-life of the peptides. In some embodiments, the attachment of a hydrophobic moiety, such as to the N-terminus, the C-terminus, or an internal amino acid, can be used to extend half-life of a peptide of the present disclosure. In other embodiments, the peptide of the present disclosure can include post-translational modifications (e.g., methylation and/or amidation), which can affect, e.g., serum half-life. In some embodiments, simple carbon chains (e.g., by myristoylation and/or palmitylation) can be conjugated to the peptides. In some embodiments, for example, the simple carbon chains may render conjugated peptides easily separable from unconjugated material. For example, methods that may be used to separate the desired peptides of the invention from unconjugated material include, but are not limited to, solvent extraction and reverse phase chromatography. In some embodiments, lipophilic moieties can be conjugated to the peptide and can extend half-life through reversible binding to serum albumin. Moreover, the conjugated moieties can be lipophilic moieties that extend half-life of the peptides through reversible binding to serum albumin. In some embodiments, the lipophilic moiety can be cholesterol or a cholesterol derivative including cholestenes, cholestanes, cholestadienes and oxysterols. In some embodiments, the peptides can be conjugated to myristic acid (tetradecanoic acid) or a derivative thereof. In other embodiments, the peptides of the present disclosure are coupled (e.g., conjugated) to a half-life modifying agent. Examples of half-life modifying agents include but are not limited to: a polymer, a polyethylene glycol (PEG), a hydroxyethyl starch, polyvinyl alcohol, a water soluble polymer, a zwitterionic water soluble polymer, a water soluble poly(amino acid), a water soluble polymer of proline, alanine and serine, a water soluble polymer containing glycine, glutamic acid, and serine, an Fc region, a fatty acid, palmitic acid, antibodies, or a molecule that binds to albumin.

In some embodiments, the first two N-terminal amino acids (GS) of SEQ ID NO: 485-SEQ ID NO: 758 can serve as a spacer or linker in order to facilitate conjugation or fusion to another molecule, as well as to facilitate cleavage of the peptide from such conjugated or fused molecules. In some embodiments, the peptides of the present disclosure can be conjugated to other moieties that can modify or effect changes to the properties of the peptides.

Active Agent Conjugates

Peptides according to the present disclosure can be conjugated or fused to a peptide biological agent or other agent comprising amino acids (e.g., an antibody or antibody fragment, receptor or receptor fragment, ligand or ligand fragment, hormone or hormone fragment, growth factors and growth factor fragments, biological toxins and fragments thereof, or other active portion of a peptide), a protein, a peptide, or to a small molecule, RNA, DNA, or other active agent molecular structure for use in the treatment of cartilage diseases, disorders, or injuries. A peptide active agent conjugate can be a peptide conjugated to an active agent by any mechanism described herein. For example, a peptide can be covalently conjugated to an active agent to form a peptide active agent conjugate. A peptide can be chemically conjugated to an active agent to form a peptide active agent conjugate. A peptide and active agent can be expressed as a fusion protein to form a peptide active agent conjugate. For example, an antibody or fragment thereof and a peptide can be expressed as a fusion protein to form a peptide active agent conjugate. For example, in certain embodiments, a peptide as described herein can be fused to another molecule, such as an active agent that provides a functional capability. A peptide can be conjugated with an active agent through expression of a vector containing the sequence of the peptide with the sequence of the active agent. In various embodiments, the sequence of the peptide and the sequence of the active agent are expressed from the same Open Reading Frame (ORF). In various embodiments, the sequence of the peptide and the sequence of the active agent can comprise a contiguous sequence. Various vectors and recombinant systems known in the art can be employed to make such fusion peptides. The peptide and the active agent can each retain similar functional capabilities in the fusion peptide compared with their functional capabilities when expressed separately.

Furthermore, for example, in certain embodiments, the peptides described herein are attached to another molecule, such as an active agent that provides a functional capability. In some embodiments, 1, 2, 3, 4, 5, 6, 7, 8, 9, or 10 active agents can be linked to a peptide. Multiple active agents can be attached by methods such as conjugating to multiple lysine residues and/or the N-terminus, or by linking the multiple active agents to a scaffold, such as a polymer or dendrimer and then attaching that agent-scaffold to the peptide (such as described in Yurkovetskiy, A. V., *Cancer Res* 75(16): 3365-72 (2015).

Described herein are active agents that can be conjugated to the peptides of the present invention for use in either cartilage disorders or kidney disorders, or both. In some embodiments, certain compounds or drugs are appropriate for use in either cartilage or kidney disorders, certain drug classes may be preferred for specific treatment depending on the indication or disorder. As described herein, it is understood that certain active agents are described in a non-limiting exemplary manner for use in treatments of cartilage and/or kidney indications. One or more of such active agents can be conjugated to a peptide of the present invention alone or in combination with one or more detectable agents described herein. In some embodiments, active agents that can be conjugated to any peptide of this disclosure can be classified by mechanism. For example, active agents can belong to the class of anti-inflammatory drugs, immunosuppressive (immune suppression) drugs, analgesics/pain relief drugs, disease modifying osteoarthritic drugs (DMOADs), cell depleting agents/apoptosis modifiers, bone resorptive agents and viscosupplementing agents, and tissue normalization (disease modifying) drugs.

Anti-inflammatory active agents can include, but are not limited to, corticosteroids, glucocorticoids, nonsteroidal anti-inflammatory drugs (NSAIDs), biologics, and other small molecules. Examples of corticosteroid active agents that can be conjugated to any peptide of this disclosure for delivery to the joints and kidneys include triamcinolone dexamethasone, budesonide, and triamcinolone acetonide. Examples of NSAID active agents that can be conjugated to any peptide of this disclosure for delivery to the joints and kidneys include naproxen and ibuprofen. Other active agents include acetylsalicylic acid and acetaminophen. NSAID active agents can be further classified into COX2 inhibitors. An example of a COX2 inhibitor active agent directed to a prostaglandin pathway that can be conjugated to any peptide of this disclosure for delivery to the joint includes celecoxib. An example of a COX2 inhibitor active agent with anti-leukotriene receptor antagonist that can be conjugated to any peptide of this disclosure for delivery to the joint includes montelukast. An example of a COX2 inhibitor active agent that can be conjugated to any peptide of this disclosure for delivery to the kidneys includes iguratimod. Biologic active agents can be further classified into active agents that are IL-1 family inhibitors, IL-17 or IL-23 pathway inhibitors, IL-6 family inhibitors, interferon receptor inhibitors, tumor necrosis factor (TNF) inhibitors, RANK pathway inhibitors, B cell inhibitors, anti-IgE active agents, and co-stimulation inhibitors. An example of an IL-1 family inhibitor active agent that can be conjugated to any peptide of this disclosure for delivery to the joints includes anakinra. An example of an IL-17/IL-23 pathway inhibitor active agent that can be conjugated to any peptide of this disclosure for delivery to the joints includes secukinumab. An example of an IL-6 family inhibitor active agent that can be conjugated to any peptide of this disclosure for delivery to the kidneys includes sirukumab. An example of an interferon receptor inhibitor active agent that can be conjugated to any peptide of this disclosure for delivery to the kidneys includes anifrolumab. An example of a TNF inhibitor active agent that can be conjugated to any peptide of this disclosure for delivery to the joints includes infliximab or etanercept. An example of a RANK pathway inhibitor active agent that can be conjugated to any peptide of this disclosure for delivery to the joints includes denosumab. An example of a B cell inhibitor active agent that can be conjugated to any peptide of this disclosure for delivery to the joints and kidneys includes rituximab. An example of an anti-IgE active agent that can be conjugated to any peptide of this disclosure for delivery to the kidneys includes omalizumab. An example of a co-stimulation inhibitor active agent that can be conjugated to any peptide of this disclosure for delivery to the joints includes abatacept.

Pain relief active agents can include, but are not limited to analgesics, counter-irritants, and pain receptor blocking drugs. Analgesics can be further classified into non-narcotic agents and narcotic agents. An example of a non-narcotic active agent that can be conjugated to any peptide of this disclosure for delivery to the joints includes acetaminophen. An example of a narcotic active agent that can be conjugated to any peptide of this disclosure for delivery to joints includes oxycodone. Counter-irritant active agents can be further classified as natural products. An example of a natural product that can be conjugated to any peptide of this disclosure for delivery to the joints includes capsaicin. Pain receptor blocking active agents can be further classified as TRPV4 inhibitors. An example of a TRPV4 inhibitor active agent that can be conjugated to any peptide of this disclosure for delivery to the joints includes GSK2193874.

Apoptosis modifier active agents can include, but are not limited to, biologics and small molecules. Biologic apoptosis modifier active agents can be further classified as Fas/FasL inhibitors, TNF/TNFR inhibitors, TRAIL/TRAILR inhibitors, TWEAK/Fn14 inhibitors, IL-1 inhibitors, IL-1 receptor antagonists, growth factors, and sclerostin inhibitors. An example of a TNF/TNFR inhibitor active agent that can be conjugated to any peptide of this disclosure for delivery to the joints includes infliximab. An example of a TRAIL/TRAILR inhibitor active agent that can be conjugated to any peptide of this disclosure for delivery to the joints includes osteoprotegrin. An example of a TWEAK/Fn14 inhibitor active agent that can be conjugated to any peptide of this disclosure for delivery to the kidneys includes BIIB023. An example of an IL-1 receptor antagonist that can be conjugated to any peptide of this disclosure for delivery to the joints includes anakinra. An example of a growth factor active agent that can be conjugated to any peptide of this disclosure for delivery to the joints includes IGF-1. An example of a growth factor active agent that can be conjugated to any peptide of this disclosure for delivery to the kidneys includes EGF. An example of a sclerostin inhibitor active agent that can be conjugated to any peptide of this disclosure for delivery to the joints includes romosozumab. Small molecule apoptosis modifier active agents can be further classified as caspase inhibitors, iNOS inhibitors, surfactants, and bisphosphonates. An example of a caspase inhibitor active agent that can be conjugated to any peptide of this disclosure for delivery to the joints includes ZVAD-fmk. An example of an iNOS inhibitor active agent that can be conjugated to any peptide of this disclosure for delivery to the joints include S-methylisothiourea. An example of a surfactant active agent that can be conjugated to any peptide of this disclosure for delivery to the joints include P188. An example of a bisphosphonate active agent that can be conjugated to any peptide of this disclosure for delivery to the joints includes alendronate. Moreover, the known class of drugs called senotherapeutics, also referred to as senolytics or senolytic drugs or senolytic compounds, refers to small molecules that can selectively induce death of senescent cells and for example by directly or indirectly inducing apoptosis in senescent cells. In addition, senolytics may also act via non-apoptotic mechanisms of cell death including by necroptis, autophagic cell death, pyroptis and caspase-independent cell death (Journal of Cell Science 127; 2135-2144 (2014)). Such drugs can attenuate age-related deterioration of tissues or organs. Examples of drugs that can be conjugated to any peptide of this disclosure to induce apoptosis or induce cell death via non-apoptotic mechanisms include quercetin, dasatinib, bortezomib, carfilzomib, and navitoclax amongst other compounds disclosed herein. Additional active agents are described in the following references: Zhu, Y et al., *Aging Cell* 14(4):644-58 (2015); Kirkland, J L, Exp Gerontol. 48(1): 1-5 (2013); Kirkland J L and Tchkonia T, Exp Gereontol. 68: 19-25 (2015) Tchkonia, T et al., J Clin Invest., 123(3): 966-72 (2013); WO2016118859; Sugumar, D et al., Pharmagenomics Pers Med. 8: 23-33 (2015); Jiafa, R et al., Sci Rep. 6: 23968 (2016); Swanson, C D et al., Nat Rev Rheumatol., 5(6): 317-324 (2009); Oh, C J et al., PLoS One, 7(10):e45870 (2012); and Adebajo, A and Boehncke, W, Psoriatic Arthritis and Psoriasis: Pathology and Clinical Aspects, Springer (2016).

Tissue normalization (disease modifying) active agents can include, but are not limited to, biologics and small molecules. Biologic active agents can be further classified as chemokines (e.g., for stem cell recruitment) and growth factors. An example of a tissue normalization chemokine active agent that can be conjugated to any peptide of this disclosure for delivery to the joints includes MIP-3a. An example of a tissue normalization growth factor active agent that can be conjugated to any peptide of this disclosure for delivery to the joints includes BMP-2. Small molecule active agents can be further classified as flavonoids, ACE inhibitors, and anti-proliferative active agents. An example of a tissue normalization flavonoid active agent that can be conjugated to any peptide of this disclosure for delivery to the joints includes icariin. An example of a tissue normalization ACE inhibitor active agent that can be conjugated to any peptide of this disclosure for delivery to the kidneys includes captopril. An example of a tissue normalization anti-proliferative active agent that can be conjugated to any peptide of this disclosure for delivery to the joints includes methotrexate.

TABLE 53 describes active agents for treatment of a cartilage disorder that can be conjugated to any peptide of the present disclosure to form peptide-drug conjugates.

TABLE 53

Exemplary Active Agents for Cartilage Disorders

| Active Agent Class | Active Agent |
| --- | --- |
| Gold compound | Gold |
| Gold compound | Auranofin |
| Gold compound | Gold Sodium Thiomalate |
| Gold compound | Gold Thioglucose |
| Gold compound | Thiomalic Acid |
| Gold compound | Gold Thiosulphate |
| Analgesics | Tramadol (e.g., Ultram, Ultracet) and derivatives |
| Analgesics | Oxycodone (e.g., Percocet, Oxycontin) and derivatives |
| Analgesics | Hydrocodone (e.g., Norco, Vicoprofen) |
| Analgesics | Morphine |
| Analgesics | Fentanyl |
| Analgesics | Oxymorphone |
| Analgesics | Hydromorphone |
| Analgesics | Meperidine |
| Analgesics | Buprenorphine |
| Analgesics | Methadone |
| Bisphosphonate | Alendronate |
| Bisphosphonate | Ibandronate |
| Bisphosphonate | Risedronate |
| Bisphosphonate | Pamidronate |
| Bisphosphonate | Zoledronate |
| Non-Nitrogen Containing First Generation Bisphosphonate | Clodronate |
| Non-Nitrogen Containing First Generation Bisphosphonate | Etidronate |
| Non-Nitrogen Containing First Generation Bisphosphonate | Tiludronate |
| Apoptosis Inhibitors | Osteoprotegerin (OPG) |
| Sclerostin Antagonist Apoptosis Inhibitors | AMG785 (Romosozumab) |
| Caspase-1 ICE Inhibitors | VX-740 (Pralnacasan) |
| Counter-irritants | Menthol |
| Counter-irritants | Capsaicin |
| RANKL Targeting Agents | Denosumab |
| Cathepsin K Targeting Agents | Odanacatib |
| TNF-α Antagonists | CDP571 |
| TNF-α Antagonists | ISIS 104838 |
| Anti-Pain Drugs | Duloxetine |
| Polymers | Low Molecular Weight Chitosan |
| Matrix Drugs | Chondroitin sulfate glucosamine |
| Cytokines/Growth Factors | TGF-beta |
| Matrix | Laminin |
| Matrix | Fibronectin |
| Matrix | Lubricin |
| Matrix | Hyaluronic acid injections |

TABLE 53-continued

Exemplary Active Agents for Cartilage Disorders

| Active Agent Class | Active Agent |
| --- | --- |
| Matrix | Glucosamine |
| Immunosuppressants | Rapamycin |
| HIF-1α Modulators | |
| HIF-2α Modulators | |
| Corticosteroid | Tixocortol pivalate |
| Glucocorticoid Corticosteroid | Hydrocortisone Acetate |
| Glucocorticoid Corticosteroid | Hydrocortisone t-Butyl Acetate |
| Glucocorticoid Corticosteroid | Prednisolone Acetate |
| Glucocorticoid Corticosteroid | Prednisolone t-Butyl Acetate |
| Corticosteroid | Dexamethasone Acetate |
| Corticosteroid | Dexamethasone t-Butyl Acetate |
| Glucocorticoid Corticosteroid | Triamcinolone Diacetate |

TABLE 54 describes active agents for treatment of a kidney disorder that can be conjugated to any peptide of the present disclosure to form peptide-drug conjugates.

TABLE 54

Exemplary Active Agents for Kidney Disorders

| Active Agent Class | Active Agent |
| --- | --- |
| ACE Inhibitors | Captopril |
| Angiotensin receptor blockers | Angiotensin receptor blocker losartan (Cozaar) |
| Hormones | Adrenocorticotropic hormone |
| Hormones | corticotropin-releasing hormone amphotericin B digitalis glycosides potassium-depleting diuretics Coumarine anticoagulants |
| NLRP3 Inflammasome Targeted Drugs | MCC950 |
| NLRP3 Inflammasome Targeted Drugs | BHB |
| NLRP3 Inflammasome Targeted Drugs | Type I interferon |
| NLRP3 Inflammasome Targeted Drugs | IFN-beta |
| NLRP3 Inflammasome Targeted Drugs | Resveratrol |
| NLRP3 Inflammasome Targeted Drugs | Arglabin |
| NLRP3 Inflammasome Targeted Drugs | CB2R agonist |
| NLRP3 Inflammasome Targeted Drugs | MicroRNA-223 |

TABLE 55 describes active agents for treatment of a cartilage disorder and a kidney disorder that can be conjugated to any peptide of the present disclosure to form peptide-drug conjugates.

TABLE 55

Exemplary Active Agents for Cartilage Disorders and Kidney Disorders

| Active Agent Class | Active Agent |
| --- | --- |
| IL-6 Receptor Modulators | Tocilizumab |
| IL-6 Receptor Modulators | Sarilumab |
| IL-6 Receptor Modulators | ALX-0061 |
| IL-6 Receptor Modulators | Sirukumab |
| IL-6 Receptor Modulators | Clazakizumab |
| IL-6 Receptor Modulators | Olokizumab |
| IL-6 Receptor Modulators | MEDI5117 |
| IL-17 Antagonists | Secukinumab |
| IL-17 Antagonists | Brodalumab |
| IL-17 Antagonists | Ixekizumab |
| Antagonists of p40 Subunit of IL-12/IL-23 | Ustekinumab |
| Antagonists of p40 Subunit of IL-12/IL-23 | Briakinumab |
| Antagonists of p19 Subunit of IL-23 | Tildrakizumab |
| Antagonists of p19 Subunit of IL-23 | Guselkumab |
| IL-23 Antagonists | Soluble IL-23 (or cytokine-binding homology region of soluble IL-23) |
| IL-1 Antagonists | Canakinumab |
| IL-1 Antagonists | Rilonacept |
| IL-1 Antagonists | Gevokizumab |
| IL-1 Antagonists | LY2189102 |
| IL-1 Antagonists | Lentiviral-mediated RNAi |
| IL-12 Antagonists | |
| IL-1 Receptor Antagonists | Anakinra |
| IL-1 Receptor Antagonists | MEDI-8968 |
| IL-1 Receptor Antagonists | AMG-108 |
| IL-1 Receptor | Kineret |
| Interleukins/Pro-Inflammatory Cytokines | Pro-inflammatory IL-1α or IL-1β |
| Interleukins | IL-8 |
| Interleukins | IL-15 |
| Interleukins | IL-18 |
| Interleukins | IL-4 |
| Interleukins | IL-10 |
| Interleukins | IL-13 |
| Interleukins | IL-22 |
| Interleukins | IL-17 |
| p38 Inhibitors | VX-745 |

TABLE 55-continued

Exemplary Active Agents for Cartilage Disorders and Kidney Disorders

| Active Agent Class | Active Agent |
| --- | --- |
| p38 Inhibitors | BIRB 796 |
| p38 Inhibitors | SCIO-469 |
| p38 Inhibitors | VX-702 |
| p38 Inhibitors | Pamapimod |
| p38 Inhibitors | ARRY-797 |
| Corticosteroids | 17-monopropionate |
| Corticosteroids | Desciclesonide |
| Corticosteroids | Flunisolide |
| Corticosteroids | Mometasone furoate |
| Corticosteroids | 22-hydroxy intermediate budesonide derivative |
| Corticosteroids | 6β-hydroxy budesonide derivative |
| Corticosteroids | Δ6-budesonide derivative |
| Corticosteroids | 23-hydroxy budesonide derivative |
| Corticosteroids | 16α-butryloxyprednisolone budesonide derivative |
| Corticosteroids | 16α-hydroxyprednisolone budesonide derivative |
| Corticosteroid (Beclomethasone) | QVAR inhalation |
| Corticosteroid (Budesonide) | pulmicort respules |
| Corticosteroid | Flovent HFA 44 |
| Corticosteroid (Mometasone) | Asmanex HFA |
| Corticosteroid (Mometasone) | Budesonide symbicort |
| Corticosteroid | Dexamethasone sodium phosphate |
| Corticosteroid | Tixocortol pivalate |
| Corticosteroid | Ciclesonide |
| Glucocorticoids | 21-nortriamcincolone acetonide |
| Glucocorticoids | Δ6-triamcinolone |
| Glucocorticoids | 6b-hydroxy triamcinolone acetonide |
| Glucocorticoids | 21-carboxy triamcinolone acetonide |
| Glucocorticoids | 6b-OH, 21-COOH triamcinolone acetonide |
| Glucocorticoids | 6α fluorocortisol |
| Glucocorticoids | 9α fluorocortisol |
| Glucocorticoids | Δ1-dehydro configuration in prednisolone |
| Glucocorticoids | 16-methylene dexamethasone derivative |
| Glucocorticoids | 16α-methyl dexamethasone derivative |
| Glucocorticoids | 16β-methyl betamethasone derivative |
| Glucocorticoids | Cyclophosphamide |
| Glucocorticoids | Mycophenolate |
| Glucocorticoids/Mineralocorticoids | Cortisol |
| Glucocorticoids/Mineralocorticoids | Hydrocortisone |
| Glucocorticoids/Mineralocorticoids | Prednisolone |
| Glucocorticoids/Mineralocorticoids | Betamethasone |
| Glucocorticoid | Fluticasone |
| Glucocorticoid | Fluticasone propionate |
| Steroid (flunisolide) | Aerobid |
| Steroid (flunisolide) | Aerobid-M |
| Steroid (flunisolide) | Aerospan |
| Steroid (Flunisolide) | Fluticasone Furoate |
| Steroid (Fluticasone) | Flovent HFA 110 |
| Steroid (Fluticasone) | Flovent HFA 220 |
| Steroid (Fluticasone) | Flovent Diskus 50 |
| Steroid (Fluticasone) | Asmanex |
| Steroid | Betamethasone acetate |
| Steroid | Betamethasone sodium phosphate |
| Steroid | Betamethasone valerate |
| Steroid | Beclomethasone dipropionate |
| Local Anesthetic | procaine hydrochloride |
| Local Anesthetic | Novacain |
| Anesthetic | bupivacaine hydrochloride |
| Anesthetic | lidocaine hydrochloride |
| Local Anesthetic | ropivacaine hydrochloride |
| Analgesics | Morphine |
| Analgesics | Fentanyl |
| Quinazolines | Feitinib/Iressa |
| Quinazolines | Sorafenib/Nexavar |
| Quinazolines | Lapatinib ditosylate/Tykerb/Tyverb |
| Quinazolines | Sunitinib/Sutent |
| Quinazolines | Bortezomib/Velcade/Cytomib |
| Quinazolines | Everolimus/Temsirolimus |
| Quinazolines | Inhibitors of IAPS |
| Quinazolines | Activators of caspase pathway |
| Quinazolines | Activators of AKT pathway |
| Quinazolines | Propylpeptidase inhibitors |
| Quinazolines | Activators of p53 |

TABLE 55-continued

Exemplary Active Agents for Cartilage Disorders and Kidney Disorders

| Active Agent Class | Active Agent |
| --- | --- |
| Quinazolines | Inhibitors of anti-apoptotic protein inhibitors |
| Prolyl Hydroxylase (PHD) Inhibitors | Desferrioxamine |
| Prolyl Hydroxylase (PHD) Inhibitors | Dimethyloxalylglycine (DMOG) |
| Prolyl Hydroxylase (PHD) Inhibitors | L-mimosine (L-mim) |
| Aptamers | Peptide aptamers |
| Aptamers | RNA aptamer A-p50 |
| Aptamers | Peptide A aptamer TrxLef1D |
| Aptamers | Aptamer E07 |
| Aptamers | Aptamer gemcitabine polymers |
| Aptamers | RAGE |
| Aptamers | Pegaptanib |
| Proteosome Inhibitors | Bortezomib |
| Proteosome Inhibitors | Carfilzomib |
| Second Generation Proteosome Inhibitors | Ixazomib |
| Second Generation Proteosome Inhibitors | Delanzomib |
| Second Generation Proteosome Inhibitors | Oprozomib |
| Second Generation Proteosome Inhibitors | Marizomib |
| Apoptosis Inhibitors | FLIP agonist |
| Apoptosis Inhibitors | nitric oxide synthase inhibitors |
| Apoptosis Inhibitors | caspase-3 inhibitors (Z-DEVD-fmk (SEQ ID NO: 1053)) |
| Apoptosis Inhibitors | caspase-9 inhibitors (Z-LEHD-fmk (SEQ ID NO: 1054)) |
| Apoptosis Inhibitors | Sclerostin antagonists |
| Apoptosis Inhibitors/Growth Factor | IGF-1 |
| BCL-2 Agonist Apoptosis Inhibitors | Oblimersen |
| BCL-2 Agonist Apoptosis Inhibitors | Obatoclax |
| BCL-2 Agonist Apoptosis Inhibitors | Navitoclax |
| BCL-2 Agonist Apoptosis Inhibitors | Venetoclax (ABT-199) |
| BCL-2 Agonist Apoptosis Inhibitors | Navotoclax (ABT-263) |
| BCL-2 Agonist Apoptosis Inhibitors | GX01 series of compounds |
| BCL-2 Agonist Apoptosis Inhibitors | BCL-2 small molecule antagonists |
| BCL-2 Agonist Apoptosis Inhibitors | Tetraocarcin-A derivatives |
| BCL-2 Agonist Apoptosis Inhibitors | Chelerythrine |
| BCL-2 Agonist Apoptosis Inhibitors | Antimycin A derivatives |
| BCL-2 Agonist Apoptosis Inhibitors | HA14-1 |
| BCL-2 Agonist Apoptosis Inhibitors | Synthetic compound antagonist of BH3 |
| BCL-2 Agonist Apoptosis Inhibitors | Genasense |
| BCL-2 Agonist Apoptosis Inhibitors | ISIS 22783 |
| BCL-2/BCL-XL Agonist Apoptosis Inhibitors | Bispecific Antisense |
| Proapoptotic BCL-2 Targeting Drugs | Bax, Bak, Bid, Bad-derived BH3 Peptides |
| Proapoptotic BCL-2 Targeting Drugs | SAHBs |
| Proapoptotic BCL-2 Targeting Drugs | BH3Is |
| BCL-2/BCL-XL Agonist Apoptosis Inhibitors | ABT-737 |
| BCL-X Inhibitors | |
| Apoptosis Modifiers | Caspase-1 Inhibitors |
| Apoptosis Modifiers | Caspase-8 Inhibitors |
| Pan-caspase Caspase Inhibitor | IDN-6556 |
| Pan-caspase Caspase Inhibitor | IDN-6734 |
| Pan-caspase Caspase Inhibitor | VX-799 |
| Pan-caspase Inhibitor | MX1013 |
| Pan-caspase Caspase Inhibitor | M-920 |
| Pan-caspase Caspase Activator | MX-2060 derivatives |
| Pan-caspase Caspase Activators | Small-molecule compounds |
| Pan-caspase Caspase Activators | RGD peptides |
| Pan-caspase inhibitors | ZVAD-fmk |
| Caspase-1 ICE Inhibitors | IDN-11104 |
| Caspase-1 ICE Inhibitors | VX-756 |
| Caspase-3 Inhibitors | M-826 |
| Caspase-3 Inhibitors | M-791 |
| Caspase-3 Inhibitors | Immunocasp-3 |
| Caspase-3 Inhibitors | Ad-G/iCasp3 |
| Caspase-3 Inhibitors | PEF-F8-CP3 |
| Caspase-6 Inhibitors | Immunocasp-6 |
| Caspase-9 Inhibitors | FKBP12/caspase-9 fusion protein |
| IAP Antagonists | BIR3 antagonists |

TABLE 55-continued

Exemplary Active Agents for Cartilage Disorders and Kidney Disorders

| Active Agent Class | Active Agent |
| --- | --- |
| XIAP Antagonists | Capped tripeptide XIAP Antagonists |
| XIAP Antagonists | Smac-mimetic compounds |
| XIAP Antagonists | AEG35156/GEM ®640 |
| XIAP Inhibitors | Embelin |
| XIAP Inhibitors | XIAP antisense and RNA constructs |
| XIAP/cIAP-1/cIAP-2 Inhibitors | Small molecule SMAC mimetics |
| IAP/Caspase Inhibitors | HIV-Tat/polyarginine-conjugated SMAC peptides |
| BIR2/Caspase-3 Inhibitors | TWX024 |
| BIR2 Inhibitors | Polyphenylurea derivatives |
| Survivin Targeting Drugs | LY2181308 |
| Survivin Targeting Drugs | Ad-Survivin T34A |
| Anti-TWEAK Apoptosis Modifiers | BIIB023 |
| Xanthine Oxidase Inhibitors | Allopurinol |
| Xanthine Oxidase Inhibitors | Febuxostat |
| Xanthine Oxidase Inhibitors | Zyloprin |
| Growth Factor | bFGF |
| Growth Factor | IGF |
| Growth Factor | TFG-beta |
| Growth Factor | BMP-2 |
| Growth Factor | BMP-9 |
| Growth Factor | BMP-13 |
| Growth Factor | BMP-7 |
| Growth Factor | BMP-3 inhibitors |
| Growth Factor | TFG-β1 |
| Growth Factor | OP-1 |
| Growth Factor | PDGF |
| Growth Factor | PTH |
| Growth Factor | PTHrP |
| Growth Factor | MIP-3α |
| Growth Factor | EPO |
| Growth Factor | FGF |
| Growth Factor | FGF-2 |
| Growth Factor | FGF-18 |
| Growth Factor | TGF-β3 |
| Growth Factor | VEGF |
| Growth Factor | Wnt proteins |
| Growth Factor | EGF |
| Growth Factor | GM-CSF |
| Flavonoid | Icariin |
| Flavonoid | Quercetin |
| Tyrosine Kinase Inhibitor (Lck/Btk Inhibitor) | Dasatinib |
| TRPV4 Activators | GSK1016790A |
| TRPV4 Activators | 4alpha-PDD |
| TRPV4 Inhibitors | HC-067047 |
| TRPV4 Inhibitors | GSK2193874 |
| NSAID | Ampion |
| NSAID | Phenylbutazone |
| NSAID | Naproxen lysozyme conjugate |
| NSAID | Acetal salicylic acid |
| DMARDs | Sulfasalazine |
| DMARDs | Leflunomide |
| DMARDs | Hydroxychloroquine (Plaquenil) |
| Disease-Modifying Osteoarthritis Drugs (DMOADs) | FGF-18 |
| Uricosurics | Sulfinpyrazone |
| MSC Matrix | Collagen |
| MSC Matrix | Fibrin |
| MSC Matrix | Polylactatous |
| Surfactant | P188 and other surfactants |
| Molecules for Bone Marrow Niches | Angiopoetin |
| Molecules for Bone Marrow Niches | Bone morphogenitic proteins |
| Molecules for Bone Marrow Niches | Epinephrine |
| Molecules for Bone Marrow Niches | Norepinephrine |
| Molecules for Bone Marrow Niches | GDF5 |
| Molecules for Bone Marrow Niches | ICAN1 |
| Molecules for Bone Marrow Niches | Jagged1 |
| Molecules for Bone Marrow Niches | Osteopontin |
| Molecules for Bone Marrow Niches | parathyroid hormone |
| Molecules for Bone Marrow Niches | Calcitonin |
| Molecules for Bone Marrow Niches | steel factor |
| Molecules for Bone Marrow Niches | Thrombopoetin |
| Molecules for Bone Marrow Niches | vascular cell adhesion molecule 1 |
| Chemokine Molecules for Bone Marrow Niches | CXCL12 |
| B Cell Targeting Agents | Rituximab |

TABLE 55-continued

Exemplary Active Agents for Cartilage Disorders and Kidney Disorders

| Active Agent Class | Active Agent |
| --- | --- |
| B Cell Targeting Agents | BLys |
| B Cell Targeting Agents | TACI |
| T Cell Co-stimulation Antagonists | Abatacept |
| JAK Targeting Agents | Tofacitinib |
| Calcineurin Inhibitors | Tacrolimus |
| Calcineurin Inhibitors | Cyclosporin |
| Calcineurin Inhibitors | Voclosporin |
| COX-2 Inhibitors | Iguratimod |
| COX-2 Inhibitors | Montelukast |
| COX-2 Inhibitors | Rofecoxib |
| COX-2 Inhibitors | Valdecoxib |
| Interferon Receptor Inhibitors | Anifrolumab |
| IFN-α Inhibitors | Sifalimumab |
| Anti-IgE Agents | Omalizumab |
| iNOS Inhibitors | S-methylisothiourea |
| CD20 Antagonists/B Cell Inhibitors | Ocrelizumab |
| BAFF Antagonists/B Cell Inhibitors | Belimumab |
| TNF Superfamily BAFF and APRIL Antagonists/B cell Inhibitors | Atacicept |
| TNF-α Antagonists | Thalidomide |
| TNF-α Antagonists | Lenalidomide |
| TNF-α Antagonists | Pomalidomide |
| TNF-α Antagonists | Pentocifylline |
| TNF-α Antagonists | Bupropion |
| TNF Antagonists | Lentiviral-mediated RNAi |
| TNF Agonists | Recombinant TNF-α |
| TRAIL Receptor Agonists | HGS-ETR1 |
| TRAIL Receptor Agonists | HGS-ETR2 |
| TRAIL Receptor Agonists | HGS-TR2J |
| TRAIL Receptor Agonists | PRO1762 |
| TRAIL Receptor Agonists | TRA-8 |
| CD95/Fas Agonists | CD95-Fc |
| Marine Bioactive Compounds | TRAIL-Resistance Overcoming Marine Bioactive Compounds |
| Marine Bioactive Compounds | mazamine A |
| Marine Bioactive Compounds | marine-derived chroomycins |
| Marine Bioactive Compounds | Carotenoids |
| Marine Bioactive Compounds | Aplysin |
| Marine Bioactive Compounds | Aplidin |
| Marine Bioactive Compounds | Siphonaxanthin |
| Marine Bioactive Compounds | pectinotoxin-2 |
| Anti-Complement Drugs | Eculizumab |
| PAR-2 Modulators | Pepducin P2pal-18 |
| miR-2013 Blockers | Anti-sense oligonucleotides |
| Nrf2 Activator | Dimethyl fumarate |
| p53 Targeting Drugs | INGN201 |
| p53 Targeting Drugs | SCH58500 |
| p53 Targeting Drugs | ONYX-015 |
| p53 Targeting Drugs | C-terminal p53 peptides |
| p53 Targeting Drugs | CDB3 |
| p53 Targeting Drugs | CP31398 |
| p53 Targeting Drugs | Prima-1 |
| p53 Targeting Drugs | HPV E6-binding peptide aptamers |
| p53 Targeting Drugs | Nutlins |
| p53 Targeting Drugs | Chalcones |
| p53 Targeting Drugs | Small peptides |
| p53 Targeting Drugs | Pifithrin-α |
| p53 Targeting Drugs/Apoptosis Modifiers (T cells) | QP1-1002 |
| Apaf-1 Targeting Drugs/Apoptosis Modifiers (T cells) | QM56 |
| Apaf-1 Targeting Drugs/Apoptosis Modifiers (T cells) | SVT016426 |
| Ferrostatin | 16/86 |
| BASP1 Targeting Drugs/Apoptosis Modifiers (T cells) | BASP siRNA |
| Anti-Inflammatory Drugs | CCX140 |
| Anti-Inflammatory Drugs | CXA-10 |
| Anti-Inflammatory Drugs/Anti-Fibrotic Drugs | Alkaline phosphatase |
| Anti-Fibrotic Drugs | Dnmt1 inhibitors |
| Anti-Inflammatory Drugs/Apoptosis Modifiers (T cells) | THR-184 |
| Immunosuppressants | Lithium |
| β2-Adrenergic Agonists | Formoterol |
| Anti-Inflammatory Drugs | CRMD-001 |

TABLE 55-continued

Exemplary Active Agents for Cartilage Disorders and Kidney Disorders

| Active Agent Class | Active Agent |
| --- | --- |
| Endothelin-1 Targeting Drugs | Astrasentan |
| Vasopressin Receptor Antagonists | Tolvaptan |
| Vasopressin Receptor Antagonists | RWJ-676070 |
| Immunosuppressants | Azathioprine |
| Immunosuppressants | Mycophenolic acid |
| Immunosuppressants | Cyclosporine |
| Immune Modulators | Laquinimod |
| Slow-acting antirheumatic drugs (SAARDs) | |
| | Colcrys |
| Hormones | parathyroid hormone |
| Hormones | growth hormone |
| | 11-beta hydroxysteroid dehydrogenases |
| | Mineralocorticoid |
| | Proopiomelanocortin |
| | fludrocortisonesoxycorticosterone acetate |
| | vaccines from live attenuated viruses |
| | Aspirin |
| | Insulin |
| | Isonizaid |
| | Oral hypoglycemic agents |
| | Antacids |
| | Carbamazepine |
| | Cholestyramine |
| | Colestipol |
| | Ephedrine |
| | Erythromycin |
| | Mitotane |
| | oral contraceptives |
| | Phenobarbital |
| | Phenytoin |
| | Rifampin |
| | Troleandomycin |
| | Non-selective caspase inhibitor |
| | okadaic acid |
| | Camptothetic |
| | Staurosporine |
| | HFA |
| | Alvesco inhalation |
| | Breo Ellipta |
| | Advair |
| | Mometasone |
| | Dulera |
| | Umeclidinium |
| | Anoro |
| Reactive Oxygen Species Targeting Drugs | |
| Cytokines/Growth Factors | TGF-beta |
| NOD-like receptor protein 3-dependent caspase 1 Targeting Drugs | |
| NSAID | Etoricoxib |
| Apoptosis Modifiers | MCL1 inhibitors |
| | Teriparatide |
| | BH3 mimetics |
| | AZD 4320 |
| Carrier Proteins | Low molecular weight human serum albumin |
| Ceramide Targeting Drugs | |
| DMARDs | Penicillamine |
| Chondrogenic factors | |
| Anti-oxidative factors | |
| A(1)AR agonist | |
| S1P(2)R antagonist | |
| Antimalarials | |

TABLE 55-continued

Exemplary Active Agents for Cartilage Disorders and Kidney Disorders

| Active Agent Class | Active Agent |
| --- | --- |
| BAX/BAK activating drugs | |
| Selective GR Activators (SEGRAs) | |
| Rap1 Targeted Drugs | |
| Senolytic | Ephrin Ligand (EFN) B1 blockers |
| Senolytic | Cyclin-dependent kinase inhibitor 1A (p21) phosphatidylinositol-4,5-bishophate 3-kinase delta catlyatic subunit (PI3KCD) blockers |
| Senolytic | Plasminogen-activated inhibitor-2 (PAI-2) blockers |
| Senesce-associated secretory phenotype (SASP) inhibitors | |
| Hormone | Tetracosactide |

TABLE 56 describes additional active agents for treatment of a cartilage disorder and a kidney disorder that can be conjugated to any peptide of the present disclosure to form peptide-drug conjugates.

TABLE 56

Exemplary Active Agents for Cartilage Disorders and Kidney Disorders

| Active Agent Class | Active Agent |
| --- | --- |
| Peptide | Oligopeptide |
| Peptide | Polypeptide |
| Peptide | Peptidomimetic |
| Nucleic Acid | Polynucleotide |
| Nucleic Acid | Polyribonucleotide |
| Nucleic Acid | Oligonucleotide |
| Nucleic Acid | DNA |
| Nucleic Acid | cDNA |
| Nucleic Acid | ssDNA |
| Nucleic Acid | RNA |
| Nucleic Acid | dsRNA |
| Nucleic Acid | micro RNA |
| Nucleic Acid | Interfering RNA |
| Nucleic Acid | Aptamer |
| Antibody | single chain variable Fragment (scFv) |
| Antibody | Antibody Fragment |
| Antibody | Aptamer |
| Antibody | Fc domains |
| Antibody | Fc regions |
| Antibody | Fc active fragments or modifications thereof |
| Cytokine | |
| Cytokine antagonists | Mavrilimumab |
| Cytokine antagonists | Ixekizumab |
| Cytokine antagonists | Tocilizumab |
| Cytokine antagonists | Anakinra |
| Cytokine antagonists | Ustekinumab |
| Cytokine antagonists | Secukinumab |
| Interferon | |
| Hormone | |
| Enzymes | |
| Growth Factor | |
| Checkpoint Inhibitor | |
| CD Antigen | |
| Chemokines | |
| Neurotransmitters | |
| Ion Channel Inhibitors | |
| G-protein coupled receptor inhibitors | |
| G-protein coupled receptor activators | |
| Tumor necrosis factor inhibitors | |
| Chemical Agents | |
| Radiosensitizers | |
| Radioprotectants | |
| Radionuclide | |
| Therapeutic Small Molecules | |
| Steroids | |
| Corticosteroids | |
| Anti-inflammatory Agents | |

TABLE 56-continued

Exemplary Active Agents for Cartilage Disorders and Kidney Disorders

| Active Agent Class | Active Agent |
| --- | --- |
| Immune Modulators | Abatacept |
| Immune Modulators | Rituximab |
| Complement Fixing Peptides or Proteins | |
| Tumor Necrosis Factor Family Inhibitors | Tumor Necrosis Factor (TNF) soluble receptor or antibody |
| Tumor Necrosis Factor Family Activators | |
| Tumor Necrosis Factor (TNF) soluble receptor or antibody | |
| Caspase protease inhibitors or activators | |
| NF-kB, RIPK1 and/or RIPK3 Inhibitors | |
| NF-kB, RIPK1 and/or RIPK3 Activators | |
| Death-receptor ligand activator or inhibitor | |
| Tumor Necrosis Factor Family Agonists | TNFR1 |
| Tumor Necrosis Factor Family Agonists | TNFR2 |
| Tumor Necrosis Factor Family Agonists | CD27/TNFRSF7 |
| Tumor Necrosis Factor Family Agonists | CD30/TNFRSF8 |
| Tumor Necrosis Factor Family Agonists | OX40/TNFRSF4 |
| Tumor Necrosis Factor Family Agonists | CD40/TNFRSF5 |
| Tumor Necrosis Factor Family Agonists | 4-1BB/TNFRSF9 |
| Tumor Necrosis Factor Family Agonists | RANK (receptor activator of NF-kappa B/TNFRSF11A) |
| Tumor Necrosis Factor Family Agonists | TWEAK receptor/TNFRSF12A |
| Tumor Necrosis Factor Family Agonists | TAC1/TNFRSF13B |
| Tumor Necrosis Factor Family Agonists | BAFF-R (BAFF receptor/TNFRSF13C) |
| Tumor Necrosis Factor Family Agonists | HVEM (herpes virus entry mediator/TNFRSF14) |
| Tumor Necrosis Factor Family Agonists | RELT/TNFRSF19L |
| Tumor Necrosis Factor Family Agonists | ectodysplasin A2 isoform receptor/TNFRS27 |
| Tumor Necrosis Factor Family Agonists | ectodysplasin A1 |
| TNF Family Member | Anhidrotic Receptor |
| Tumor Necrosis Factor Family Antagonists | Decoy Receptor 3/TNFRSF6B |
| Tumor Necrosis Factor Family Antagonists | Decoy Receptor 1/TNFRSF10C |
| Tumor Necrosis Factor Family Antagonists | Decoy Receptor 2/TNFRSF10D |
| Tumor Necrosis Factor Family Antagonists | DR3 (death receptor 3/TNFRSF25) |
| Tumor Necrosis Factor Family Antagonists | DR4 (death receptor 4/TNFRSF10A) |
| Tumor Necrosis Factor Family Antagonists | DR5 (death receptor 5/TNFRSF10B) |
| Tumor Necrosis Factor Family Antagonists | DR6 (death receptor 6/TNFRSF21) |
| Tumor Necrosis Factor Family Antagonists | Fas/TNFRSF6 |
| Tumor Necrosis Factor Family Antagonists | Lymphotoxin b receptor/TNFRS3 |
| Tumor Necrosis Factor Family Antagonists | OPG (osteoprotegerin/TNFRSF11B) |
| Tumor Necrosis Factor Family Antagonists | Nerve Growth Factor Receptor/TNFRSF16 |
| Tumor Necrosis Factor Family Antagonists | BCMA (B Cell Maturation Antigen/TNFRSF17) |
| Tumor Necrosis Factor Family Antagonists | GITR (Glucocorticoid-Induced TNF Receptor/TNFRSF18) |

TABLE 56-continued

Exemplary Active Agents for Cartilage Disorders and Kidney Disorders

| Active Agent Class | Active Agent |
| --- | --- |
| Tumor Necrosis Factor Family Antagonists | TAJ (Toxicity and JNK Inducer/TNFRSF19) |
| Tumor Necrosis Factor Family Antagonists | TNFRSF22 |
| Tumor Necrosis Factor Family Antagonists | TNFRSF23 |
| TNF Receptor Superfamily Ligands | TNF alpha |
| TNF Receptor Superfamily Ligands | Lymphotoxin-a |
| TNF Receptor Superfamily Ligands | Tumor Necrosis Factor Membrane Form |
| TNF Receptor Superfamily Ligands | Tumor Necrosis Factor Shed Form |
| TNF Receptor Superfamily Ligands | LIGHT |
| TNF Receptor Superfamily Ligands | Lymphotoxin b2a1 heterotrimer |
| TNF Receptor Superfamily Ligands | OX-40 Ligand |
| TNF Receptor Superfamily Ligands | Compound 1 [PMID: 24930776] |
| TNF Receptor Superfamily Ligands | CD40 Ligand |
| TNF Receptor Superfamily Ligands | Fas Ligand |
| TNF Receptor Superfamily Ligands | TL1A |
| TNF Receptor Superfamily Ligands | CD70 |
| TNF Receptor Superfamily Ligands | CD30 Ligand |
| TNF Receptor Superfamily Ligands | TRAF1 |
| TNF Receptor Superfamily Ligands | TRAF2 |
| TNF Receptor Superfamily Ligands | TRAF3 |
| TNF Receptor Superfamily Ligands | TRAIL |
| TNF Receptor Superfamily Ligands | RANK Ligand |
| TNF Receptor Superfamily Ligands | APRIL |
| TNF Receptor Superfamily Ligands | BAFF |
| TNF Receptor Superfamily Ligands | B and T lymphocyte Attenuators |
| TNF Receptor Superfamily Ligands | NGF |
| TNF Receptor Superfamily Ligands | BDNF |
| TNF Receptor Superfamily Ligands | Neurotrophin-3 |
| TNF Receptor Superfamily Ligands | Neurotrophin-4 |
| TNF Receptor Superfamily Ligands | TL6 |
| TNF Receptor Superfamily Ligands | Ectodysplasin A2 |
| TNF Receptor Superfamily Ligands | Ectodysplasin A1 |
| TNF blockers | Remicade (infliximab) |
| TNF blockers | Enbrel (etanercept) |
| TNF blockers | Humira (adalimumab) |
| TNF blockers | Cimzia (certolizumab pegol) |
| TNF blockers | Simponi (golimumab) |
| Tumor Necrosis Factor Receptor Family Agonists | |
| Toll Like Receptors Agonist | |
| TIMP-3 Inhibitors | |
| BCL-2 Family Inhibitors | |
| IAP Disruptors | |
| Protease Inhibitors | |
| Amino Sugars | |
| Chemotherapeutic | |
| Cytotoxic chemical | |
| Toxins | |
| Tyrosine Kinase inhibitors | Imatinib Mesylate |
| Protons | |
| Antivascular Agents | Bevacizumab |
| EGFR Inhibitors | Erlotinib |
| Anti-Infective Agents | |
| Antibiotics | |
| Anti-Viral Agents | |
| Anti-Fungal Agents | |
| Aminoglycoside | |
| Statins | |
| Nanoparticles | |
| Liposomes | |
| Polymers | Biopolymers |
| Polysaccharide | |
| Proteoglycan | |
| Glycosaminoglycans | |
| Polyethylene glycol | |
| Lipids | |
| Dendrimers | |
| Fatty Acids | |
| Glucocorticoid | |
| Corticosteroid | |
| Collagenase Inhibitor | |
| Matrix Metalloprotease Inhibitors | MMP-13 inhibitor |
| Vitamins | Vitamin D |
| Antibiotics | |

TABLE 56-continued

Exemplary Active Agents for Cartilage Disorders and Kidney Disorders

| Active Agent Class | Active Agent |
| --- | --- |
| Antiviral | |
| Antifungal | |
| Statins | |
| Immune Modulators | |
| Radioisotopes | |
| Toxins | |
| Enzymes | |
| Sensitizing drugs | |
| Anti-Angiogenic Agents | Cisplatin |
| Anti-Angiogenic Agents | Anti-Metabolites |
| Anti-Angiogenic Agents | Mitotic Inhibitors |
| Anti-Angiogenic Agents | Growth Factor Inhibitors |
| Chemotherapeutic Agent | Paclitaxel |
| Chemotherapeutic Agent | Temozolomide |
| Chemotherapeutic Agent | Topotecan |
| Chemotherapeutic Agent | Fluorouracil |
| Chemotherapeutic Agent | Vincristine |
| Chemotherapeutic Agent | Vinblastine |
| Chemotherapeutic Agent | Procarbazine |
| Chemotherapeutic Agent | Decarbazine |
| Chemotherapeutic Agent | Altretamine |
| Chemotherapeutic Agent | Methotrexate |
| Chemotherapeutic Agent | Mercaptopurine |
| Chemotherapeutic Agent | Thioguanine |
| Chemotherapeutic Agent | Fludarabine Phosphate |
| Chemotherapeutic Agent | Cladribine |
| Chemotherapeutic Agent | Pentostatin |
| Chemotherapeutic Agent | Cytarabine |
| Chemotherapeutic Agent | Azacitidine |
| Chemotherapeutic Agent | Etoposide |
| Chemotherapeutic Agent | Teniposide |
| Chemotherapeutic Agent | Irinotecan |
| Chemotherapeutic Agent | Docetaxel |
| Chemotherapeutic Agent | Doxorubicin |
| Chemotherapeutic Agent | Daunorubicin |
| Chemotherapeutic Agent | Dactinomycin |
| Chemotherapeutic Agent | Idarubicin |
| Chemotherapeutic Agent | Plicamycin |
| Chemotherapeutic Agent | Mitomycin |
| Chemotherapeutic Agent | Bleomycin |
| Chemotherapeutic Agent | Tamoxifen |
| Chemotherapeutic Agent | Flutamide |
| Chemotherapeutic Agent | Leuprolide |
| Chemotherapeutic Agent | Goserelin |
| Chemotherapeutic Agent | Aminogluthimide |
| Chemotherapeutic Agent | Anastrozole |
| Chemotherapeutic Agent | Amsacrine |
| Chemotherapeutic Agent | Asparaginase |
| Chemotherapeutic Agent | Mitoxantrone |
| Chemotherapeutic Agent | Mitotane |
| Chemotherapeutic Agent | Amifostine |
| Apoptotic Agents | |
| Cell Death or Cell Killing Agents | Caspases |
| Apoptosis Activators | |
| Apoptosis Inhibitors | XBP-1 |
| Apoptosis Inhibitors | Bcl-2 |
| Apoptosis Inhibitors | Bcl-Xl |
| Apoptosis Inhibitors | Bcl-w |
| Nonsteroidal Anti-Inflammatory Drugs (NSAID) | COX-2 Inhibitors |
| Nonsteroidal Anti-Inflammatory Drugs (NSAID) | Ketorolac |
| Nonsteroidal Anti-Inflammatory Drugs (NSAID) | Indomethacin |
| Nonsteroidal Anti-Inflammatory Drugs (NSAID) | Etodolac |
| Nonsteroidal Anti-Inflammatory Drugs (NSAID) | Tolemetin |
| Nonsteroidal Anti-Inflammatory Drugs (NSAID) | Naproxen |
| Nonsteroidal Anti-Inflammatory Drugs (NSAID) | Enolic Acid Derivatives |
| Nonsteroidal Anti-Inflammatory Drugs (NSAID) | Anthranilic Acid Derivatives |
| Nonsteroidal Anti-Inflammatory Drugs (NSAID) | Celecoxib |

TABLE 56-continued

Exemplary Active Agents for Cartilage Disorders and Kidney Disorders

| Active Agent Class | Active Agent |
| --- | --- |
| Nonsteroidal Anti-Inflammatory Drugs (NSAID) | Sulfonanilides |
| Nonsteroidal Anti-Inflammatory Drugs (NSAID) | Salicylates |
| Nonsteroidal Anti-Inflammatory Drugs (NSAID) | Aceclofenac |
| Nonsteroidal Anti-Inflammatory Drugs (NSAID) | Nabumetone |
| Nonsteroidal Anti-Inflammatory Drugs (NSAID) | Sulindac |
| Nonsteroidal Anti-Inflammatory Drugs (NSAID) | Diclofenac |
| Nonsteroidal Anti-Inflammatory Drugs (NSAID) | Ibuprofen |
| Steroids | Dexamethasone |
| Steroids | Budesonide |
| Steroids | Triamcinolone |
| Steroids | Triamcinolone acetonide |
| Steroids | Cortisone |
| Steroids | Prednisone |
| Steroids | Prednisolone |
| Steroids | Triamcinolone Hexacetonide |
| Steroids | Methylprednisolone |
| Pain Reliever | Acetaminophen |
| Opioids | |
| Local Anesthetics | |
| Anti-Depressants | |
| Glutamate Receptor Antagonists | |
| | Adenosine |
| Neuropeptides | |
| Uricase | |
| Elastase | |

Further examples of active agents include but are not limited to: a peptide, an oligopeptide, a polypeptide, a peptidomimetic, a polynucleotide, a polyribonucleotide, a DNA, a cDNA, a ssDNA, a RNA, a dsRNA, a micro RNA, an RNAi, an oligonucleotide, an antibody, a single chain variable fragment (scFv), an antibody fragment, an aptamer, a cytokine, an interferon, a hormone, an enzyme, a growth factor, a checkpoint inhibitor, a PD-1 inhibitor, a PD-L1 inhibitor, a CTLA4 inhibitor, a CD antigen, aa chemokine, a neurotransmitter, an ion channel inhibitor, a G-protein coupled receptor inhibitor, a G-protein coupled receptor activator, a chemical agent, a radiosensitizer, a radioprotectant, a radionuclide, a therapeutic small molecule, a steroid, a corticosteroid, an anti-inflammatory agent, an immune modulator, a complement fixing peptide or protein, a tumor necrosis factor inhibitor, a tumor necrosis factor activator, a tumor necrosis factor receptor family agonist, a tumor necrosis receptor antagonist, a tumor necrosis factor (TNF) soluble receptor or antibody, caspase protease activator or inhibitor, an NF-κB a RIPK1 and/or RIPK3 inhibitor or activator (e.g., through Toll-like receptors (TLRs) TLR-3 and/or TLR-4, or T-cell receptor (TCR) and the like), a death-receptor ligand (e.g., Fas ligand) activator or inhibitor, TNF receptor family (e.g., TNFR1, TNFR2, lymphotoxin β receptor/TNFRS3, OX40/TNFRSF4, CD40/TN-FRSF5, Fas/TNFRSF6, decoy receptor 3/TNFRSF6B, CD27/TNFRSF7, CD30/TNFRSF8, 4-1BB/TNFRSF9, DR4 (death receptor 4/TNFRS10A), DR5 (death receptor 5/TNFRSF10B), decoy receptor 1/TNFRSF10C, decoy receptor 2/TNFRSF10D, RANK (receptor activator of NF-kappa B/TNFRSF11A), OPG (osteoprotegerin/TNFRSF11B), DR3 (death receptor 3/TNFRSF25), TWEAK receptor/TNFRSF12A, TACU/TNFRSF13B, BAFF-R (BAFF receptor/TNFRSF13C), HVEM (herpes virus entry mediator/TNFRSF14), nerve growth factor receptor/TNFRSF16, BCMA (B cell maturation antigen/TNFRSF17), GITR (glucocorticoid-induced TNF receptor/TNFRSF18), TAJ (toxicity and JNK inducer/TNFRSF19), RELT/TNFRSF19L, DR6 (death receptor 6/TNFRSF21), TNFRSF22, TNFRSF23, ectodysplasin A2 isoform receptor/TNFRS27, ectodysplasin 1, and anhidrotic receptor, a TNF receptor superfamily ligand including—TNF alpha, lymphotoxin-α, tumor necrosis factor membrane form, tumor necrosis factor shed form, LIGHT, lymphotoxin $β_2α_1$ heterotrimer, OX-40 ligand, compound 1 [PMID: 24930776], CD40 ligand, Fas ligand, TL1A, CD70, CD30 ligand, TRAF1, TRAF2, TRAF3, TRAIL, RANK ligand, APRIL, BAFF, B and T lymphocyte attenuator, NGF, BDNF, neurotrophin-3, neurotrophin-4, TL6, ectodysplasin A2, ectodysplasin A1—a TIMP-3 inhibitor, a BCL-2 family inhibitor, navitoclax (Aging Cell. 15(3): 428-435. (2016)) an IAP disruptor, a protease inhibitor, an amino sugar, a chemotherapeutic (whether acting through an apoptotic or non-apoptotic pathway) (Ricci et al. Oncologist 11(4):342-57 (2006)), a cytotoxic chemical, a toxin, a tyrosine kinase inhibitor (e.g., imatinib mesylate), protons, bevacuzimab (antivascular agent), erlotinib (EGFR inhibitor), an anti-infective agent, an antibiotic, an anti-viral agent, an anti-fungal agent, an aminoglycoside, a nonsteroidal anti-inflammatory drug (NSAID), a statin, a nanoparticle, a liposome, a polymer, a biopolymer, a polysaccharide, a proteoglycan, a glycosaminoglycan, polyethylene glycol, a lipid, a dendrimer, a fatty acid, or an Fc domain or an Fc region, or an active fragment or a modification thereof. Any combination of the above active agents can be co-delivered with peptides or peptide conjugates of this disclosure. Additionally, in some embodiments, other co-therapies such as proton therapy or ablative radiotherapy can be administered to a subject in need thereof along with peptides or peptide conjugates of this disclosure. In some embodiments, the peptide is covalently or non-covalently linked to an active agent, e.g., directly or via a linker. TNF blockers suppress the immune system by blocking the activity of TNF, a substance in the body that can cause inflammation and lead to immune-system diseases, such as Crohn's disease, ulcerative colitis, rheumatoid arthritis, ankylosing spondylitis, psoriatic arthritis and plaque psoriasis. The drugs in this class include Remicade (infliximab), Enbrel (etanercept), Humira (adalimumab), Cimzia (certolizumab pegol) and Simponi (golimumab). The peptide disclosed herein can be used to home, distribute to, target, directed to, is retained by, accumulate in, migrate to, and/or bind to cartilage, and thus also be used for localizing the attached or fused active agent. Furthermore, cystine-dense chlorotoxin peptide can be internalized in cells (Wiranowska, M., *Cancer Cell Int.*, 11: 27 (2011)). Therefore, cellular internalization, subcellular localization, and intracellular trafficking after internalization of the peptide itself, or an active agent peptide conjugate or fusion peptide can be important factors in the efficacy of an active agent conjugate or fusion. (Ducry, L., *Antibody Drug Conjugates* (2013); and Singh, S. K., *Pharm Res.*, 32(11): 3541-3571 (2015)). Exemplary linkers suitable for use with the embodiments herein are discussed in further detail below.

The peptides or peptide-active agent fusions of the present disclosure can also be conjugated to other moieties that can serve other roles, such as providing an affinity handle (e.g., biotin) for retrieval of the peptides from tissues or fluids. For example, peptides or peptide-active agent fusions of the present disclosure can also be conjugated to biotin. In addition to extension of half-life, biotin could also act as an affinity handle for retrieval of peptides or peptide-active agent fusions from tissues or other locations. In some embodiments, fluorescent biotin conjugates that can act both as a detectable label and an affinity handle can be used. Non limiting examples of commercially available fluorescent biotin conjugates include Atto 425-Biotin, Atto 488-Biotin, Atto 520-Biotin, Atto-550 Biotin, Atto 565-Biotin, Atto 590-Biotin, Atto 610-Biotin, Atto 620-Biotin, Atto 655-Biotin, Atto 680-Biotin, Atto 700-Biotin, Atto 725-Biotin, Atto 740-Biotin, fluorescein biotin, biotin-4-fluorescein, biotin-(5-fluorescein) conjugate, and biotin-B-phycoerythrin, Alexa fluor 488 biocytin, Alexa flour 546, Alexa Fluor 549, lucifer yellow cadaverine biotin-X, Lucifer yellow biocytin, Oregon green 488 biocytin, biotin-rhodamine and tetramethylrhodamine biocytin. In some other examples, the conjugates could include chemiluminescent compounds, colloidal metals, luminescent compounds, enzymes, radioisotopes, and paramagnetic labels. In some embodiments, the peptide-active agent fusions described herein can be attached to another molecule. For example, the peptide sequence also can be attached to another active agent (e.g., small molecule, peptide, polypeptide, polynucleotide, antibody, aptamer, cytokine, growth factor, neurotransmitter, an active fragment or modification of any of the preceding, fluorophore, radioisotope, radionuclide chelator, acyl adduct, chemical linker, or sugar, etc.). In some embodiments, the peptide can be fused with, or covalently or non-covalently linked to an active agent.

Additionally, more than one peptide sequence can be present on or fused with a particular peptide. A peptide can be incorporated into a biomolecule by various techniques, for example by a chemical transformation, such as the formation of a covalent bond, such as an amide bond, or by solid phase or solution phase peptide synthesis, or by preparing a nucleic acid sequence encoding the biomolecule, wherein the nucleic acid sequence includes a subsequence that encodes the peptide. The subsequence can be in addition to the sequence that encodes the biomolecule, or can substitute for a subsequence of the sequence that encodes the biomolecule.

Detectable Agent Conjugates

Described herein are agents that can be conjugated to the peptides of the present invention for use in detection and tracing either cartilage disorders or kidney disorders, or both. As described herein, it is understood that certain active agents are described in a non-limiting exemplary manner for use in diagnostics, aiding surgery and treatment, prognosis and tracking of progress or remission of cartilage and/or kidney disorders, diseases or injury. One or more of such detectable agents can be conjugated to a peptide of the present invention alone or in combination with one or more active agents described herein. Moreover some detectable agents (e.g., radionuclides, radioisotopes, radiosensitizers and photosensitizers amongst others) may also exert therapeutic activity as well. A peptide can be conjugated to an agent used in imaging, research, therapeutics, theranostics, pharmaceuticals, chemotherapy, chelation therapy, targeted drug delivery, and radiotherapy. The agent can be a detectable agent. In some embodiments, a peptide of the present invention is conjugated to detectable agents, such as a metal, a radioisotope, a dye, fluorophore, or another suitable material that can be used in imaging. Non-limiting examples of radioisotopes include alpha emitters, beta emitters, positron emitters, and gamma emitters. In some embodiments, the metal or radioisotope is selected from the group consisting of actinium, americium, bismuth, cadmium, cesium, cobalt, europium, gadolinium, iridium, lead, lutetium, manganese, palladium, polonium, radium, ruthenium, samarium, strontium, technetium, thallium, and yttrium. In some embodiments, the metal is actinium, bismuth, lead, radium, strontium, samarium, or yttrium. In some embodiments, the radioisotope is actinium-225 or lead-212. In some embodiments, the fluorophore is a fluorescent agent emitting electromagnetic radiation at a wavelength between 650 nm and 4000 nm, such emissions being used to detect such agent. In some embodiments the fluorophore is a fluorescent agent is selected from the group consisting of non-limiting examples of fluorescent dyes that could be used as a conjugating molecule (or as applied to each class of molecules) in the present disclosure include DyLight-680, DyLight-750, VivoTag-750, DyLight-800, IRDye-800, VivoTag-680, Cy5.5, or indocyanine green (ICG class of dyes). In some embodiments, near infrared dyes include cyanine dyes. Additional non-limiting examples of fluorescent dyes for use as a conjugating molecule in the present disclosure include acradine orange or yellow, Alexa Fluors and any derivative thereof, 7-actinomycin D, 8-anilinonaphthalene-1-sulfonic acid, ATTO dye and any derivative thereof, auramine-rhodamine stain and any derivative thereof, bensantrhone, bimane, 9-10-bis(phenylethynyl)anthracene, 5,12-bis(phenylethynyl)naththacene, bisbenzimide, brainbow, calcein, carbodyfluorescein and any derivative thereof, 1-chloro-9,10-bis(phenylethynyl)anthracene and any derivative thereof, DAPI, DiOC6, DyLight Fluors and any derivative thereof, epicocconone, ethidium bromide, FlAsH-EDT2, Fluo dye and any derivative thereof, FluoProbe and any derivative thereof, Fluorescein and any derivative thereof, Fura and any derivative thereof, GelGreen and any derivative thereof, GelRed and any derivative thereof, fluorescent proteins and any derivative thereof, m isoform proteins and any derivative thereof such as for example mCherry, hetamethine dye and any derivative thereof, hoechst stain, iminocoumarin, indian yellow, indo-1 and any derivative thereof, laurdan, lucifer yellow and any derivative thereof, luciferin and any derivative thereof, luciferase and any derivative thereof, mercocyanine and any derivative thereof, nile dyes and any derivative thereof, perylene, phloxine, phyco dye and any derivative thereof, propium iodide, pyranine, rhodamine and any derivative thereof, ribogreen, RoGFP, rubrene, stilbene and any derivative thereof, sulforhodamine and any derivative thereof, SYBR and any derivative thereof, synaptopHluorin, tetraphenyl butadiene, tetrasodium tris, Texas Red, Titan Yellow, TSQ, umbelliferone, violanthrone, yellow fluorescent protein and YOYO-1. Other Suitable fluorescent dyes include, but are not limited to, fluorescein and fluorescein dyes (e.g., fluorescein isothiocyanine or FITC, naphthofluorescein, 4', 5'-dichloro-2',7'-dimethoxyfluorescein, 6-carboxyfluorescein or FAM, etc.), carbocyanine, merocyanine, styryl dyes, oxonol dyes, phycoerythrin, erythrosin, eosin, rhodamine dyes (e.g., carboxytetramethylrhodamine or TAMRA, carboxyrhodamine 6G, carboxy-X-rhodamine (ROX), lissamine rhodamine B, rhodamine 6G, rhodamine Green, rhodamine Red, tetramethylrhodamine (TMR), etc.), coumarin and coumarin dyes (e.g., methoxycoumarin, dialkylaminocoumarin, hydroxycoumarin, aminomethylcoumarin (AMCA), etc.), Oregon Green Dyes (e.g., Oregon Green 488, Oregon Green 500, Oregon Green 514, etc.), Texas Red, Texas Red-X, SPECTRUM RED, SPECTRUM GREEN, cyanine dyes (e.g., CY-3, Cy-5, CY-3.5, CY-5.5, etc.), ALEXA FLUOR dyes (e.g., ALEXA FLUOR 350, ALEXA FLUOR 488, ALEXA FLUOR 532, ALEXA FLUOR 546, ALEXA FLUOR 568, ALEXA FLUOR 594, ALEXA FLUOR 633, ALEXA FLUOR 660, ALEXA FLUOR 680, etc.), BODIPY dyes (e.g., BODIPY FL, BODIPY R6G, BODIPY TMR, BODIPY TR, BODIPY 530/550, BODIPY 558/568, BODIPY 564/570, BODIPY 576/589, BODIPY 581/591, BODIPY 630/650, BODIPY 650/665, etc.), IRDyes (e.g., IRD40, IRD 700, IRD 800, etc.), indocyanine green dyes and the like. For each of the above listed fluorescent dyes various activated forms can be used for conjugation. Additional suitable detectable agents are described in PCT/US14/56177. Non-limiting examples of radioisotopes include alpha emitters, beta emitters, positron emitters, and gamma emitters. In some embodiments, the metal or radioisotope is selected from the group consisting of actinium, americium, bismuth, cadmium, cesium, cobalt, europium, gadolinium, iridium, lead, lutetium, manganese, palladium, polonium, radium, ruthenium, samarium, strontium, technetium, thallium, and yttrium. In some embodiments, the metal is actinium, bismuth, lead, radium, strontium, samarium, or yttrium. In some embodiments, the radioisotope is actinium-225 or lead-212.

Other embodiments of the present disclosure provide peptides conjugated to a radiosensitizer or photosensitizer. Examples of radiosensitizers include but are not limited to: ABT-263, ABT-199, WEHI-539, paclitaxel, carboplatin, cisplatin, oxaliplatin, gemcitabine, etanidazole, misonidazole, tirapazamine, and nucleic acid base derivatives (e.g., halogenated purines or pyrimidines, such as 5-fluorodeoxyuridine). Examples of photosensitizers include but are not limited to: fluorescent molecules or beads that generate heat when illuminated, porphyrins and porphyrin derivatives (e.g., chlorins, bacteriochlorins, isobacteriochlorins, phthalocyanines, and naphthalocyanines), metalloporphyrins, metallophthalocyanines, angelicins, chalcogenapyrrillium dyes, chlorophylls, coumarins, flavins and related compounds such as alloxazine and riboflavin, fullerenes, pheophorbides, pyropheophorbides, cyanines (e.g., merocyanine 540), pheophytins, sapphyrins, texaphyrins, purpurins, porphycenes, phenothiaziniums, methylene blue derivatives, naphthalimides, nile blue derivatives, quinones, perylenequinones (e.g., hypericins, hypocrellins, and cercosporins), psoralens, quinones, retinoids, rhodamines, thiophenes, verdins, xanthene dyes (e.g., eosins, erythrosins, rose bengals), dimeric and oligomeric forms of porphyrins, and prodrugs such as 5-aminolevulinic acid. Advantageously, this approach allows for highly specific targeting of diseased cells (e.g., cancer cells) using both a therapeutic agent (e.g., drug) and electromagnetic energy (e.g., radiation or light) concurrently. In some embodiments, the peptide is covalently or non-covalently linked to the agent, e.g., directly or via a linker. Exemplary linkers suitable for use with the embodiments herein are discussed in further detail below.

Linkers

Peptides according to the present disclosure that home, target, migrate to, are retained by, accumulate in, and/or bind to, or are directed to the cartilage can be attached to another moiety (e.g., an active agent), such as a small molecule, a second peptide, a protein, an antibody, an antibody fragment, an aptamer, polypeptide, polynucleotide, a fluorophore, a radioisotope, a radionuclide chelator, a polymer, a biopolymer, a fatty acid, an acyl adduct, a chemical linker, or sugar or other active agent described herein through a linker, or directly in the absence of a linker.

A peptide can be directly attached to another molecule by a covalent attachment. For example, the peptide is attached to a terminus of the amino acid sequence of a larger polypeptide or peptide molecule, or is attached to a side chain, such as the side chain of a lysine, serine, threonine, cysteine, tyrosine, aspartic acid, a non-natural amino acid residue, or glutamic acid residue. The attachment can be via an amide bond, an ester bond, an ether bond, a carbamate bond, a carbon-nitrogen bond, a triazole, a macrocycle, an oxime bond, a hydrazone bond, a carbon-carbon single double or triple bond, a disulfide bond, or a thioether bond. In some embodiments, similar regions of the disclosed peptide(s) itself (such as a terminus of the amino acid sequence, an amino acid side chain, such as the side chain of a lysine, serine, threonine, cysteine, tyrosine, aspartic acid, a non-natural amino acid residue, or glutamic acid residue, via an amide bond, an ester bond, an ether bond, a carbamate bond, a carbon-nitrogen bond, a triazole, a macrocycle, an oxime bond, a hydrazone bond, a carbon-carbon single double or triple bond, a disulfide bond, or a thioether bond, or linker as described herein) can be used to link other molecules.

Attachment via a linker can involve incorporation of a linker moiety between the other molecule and the peptide. The peptide and the other molecule can both be covalently attached to the linker. The linker can be cleavable, labile, non-cleavable, stable self-immolating, hydrophilic, or hydrophobic. As used herein, the term "non-cleavable" (such as used in association with an amide, cyclic, or carbamate linker or as otherwise as described herein) is often used by a skilled artisan to distinguish a relatively stable structure from one that is more labile or "cleavable" (e.g., as used in association with cleavable linkers that may be dissociated or cleaved structurally by enzymes, proteases, self-immolation, pH, reduction, hydrolysis, certain physiologic conditions, or as otherwise described herein). It is understood that "non-cleavable" linkers offer stability against cleavage or other dissociation as compared to "cleavable" linkers, and the term is not intended to be considered an absolute non-cleavable or non-dissociative structure under any conditions. Consequently, as used herein, a "non-cleavable" linker is also referred to as a "stable" linker. The linker can have at least two functional groups with one bonded to the peptide, the other bonded to the other molecule, and a linking portion between the two functional groups.

Non-limiting examples of the functional groups for attachment can include functional groups capable of forming an amide bond, an ester bond, an ether bond, a carbonate bond, a carbamate bond, or a thioether bond. Non-limiting examples of functional groups capable of forming such bonds can include amino groups; carboxyl groups; hydroxyl groups; aldehyde groups; azide groups; alkyne and alkene groups; ketones; hydrazides; acid halides such as acid fluorides, chlorides, bromides, and iodides; acid anhydrides, including symmetrical, mixed, and cyclic anhydrides; carbonates; carbonyl functionalities bonded to leaving groups such as cyano, succinimidyl, and N-hydroxysuccinimidyl; hydroxyl groups; sulfhydryl groups; and molecules possessing, for example, alkyl, alkenyl, alkynyl, allylic, or benzylic leaving groups, such as halides, mesylates, tosylates, triflates, epoxides, phosphate esters, sulfate esters, and besylates.

Non-limiting examples of the linking portion can include alkylene, alkenylene, alkynylene, polyether, such as polyethylene glycol (PEG), hydroxy carboxylic acids, polyester, polyamide, polyamino acids, polypeptides, cleavable peptides, valine-citrulline, aminobenzylcarbamates, D-amino acids, and polyamine, any of which being unsubstituted or substituted with any number of substituents, such as halogens, hydroxyl groups, sulfhydryl groups, amino groups, nitro groups, nitroso groups, cyano groups, azido groups, sulfoxide groups, sulfone groups, sulfonamide groups, carboxyl groups, carboxaldehyde groups, imine groups, alkyl groups, halo-alkyl groups, alkenyl groups, halo-alkenyl groups, alkynyl groups, halo-alkynyl groups, alkoxy groups, aryl groups, aryloxy groups, aralkyl groups, arylalkoxy groups, heterocyclyl groups, acyl groups, acyloxy groups, carbamate groups, amide groups, urethane groups, epoxides, and ester groups.

A peptide and drug conjugated via a linker is described with the formula Peptide-A-B-C-Drug, wherein the linker is A-B-C. A can be a stable amide link, is an amine on the peptide and the linker and can be achieved via a tetrafluorophenyl (TFP) ester or an NHS ester. B can be ($-CH2-$)$_x$- or a short PEG ($-CH_2CH_2O-$)$_x$ (x is 1-10), and C can be the ester bond to the hydroxyl or carboxylic acid on the drug. In some embodiments, C can refer to the "cleavable" or "stable" part of the linker. In other embodiments, A can also be the "cleavable" part. In some embodiments, A can be amide, carbamate, thioether via maleimide or bromoacetamide, triazole, oxime, or oxacarboline. The cleaved active agent or drug can retain the chemical structure of the active agent before cleavage, or can be modified as a result of cleavage. Moreover, depending on the desired therapeutic properties of the peptide-drug conjugate, such active agent can be active while linked to the peptide, remain active after cleavage or become inactivated, be inactive while linked to the peptide, or it can be activated upon cleavage.

In some embodiments, peptide conjugates have stable linkers. A peptide of the disclosure can be expressed recombinantly or chemically synthesized. The peptide can be conjugated to a detectable agent or an active agent via a stable linker, such as an amide linkage or a carbamate linkage. The peptide can be conjugated to a detectable agent or an active agent via a stable linker, such as an amide bond using standard 1-ethyl-3-(3-dimethylaminopropyl)carbodiimide (EDC) or dicylcohexylcarbodiimide (DCC) based chemistry or thionyl chloride or phosphorous chloride-based bioconjugation chemistries. A stable linker may or may not be cleaved in buffer over extended periods of time (e.g., hours, days, or weeks). A stable linker may or may not be cleaved in body fluids such as plasma or synovial fluid over extended periods of time (e.g., hours, days, or weeks). A stable linker, may or may not be cleaved after exposure to enzymes, reactive oxygen species, other chemicals or enzymes that can be present in cells (e.g., macrophages), cellular compartments (e.g., endosomes and lysosomes), inflamed areas of the body (e.g., inflamed joints), tissues or body compartments. A stable linker may be cleaved by unknown mechanisms. A stable linker may or may not be cleaved in vivo but remains an active agent after peptide conjugation.

A peptide and drug conjugated via a linker can be described with the formula Peptide-A-B-C-Drug, wherein the linker is A-B-C. A can be a stable amide link such as that formed by reacting an amine on the peptide with a linker containing a tetrafluorophenyl (TFP) ester or an NHS ester. A can also be a stable carbamate linker such as that formed by reacting an amine on the peptide with an imidazole carbamate active intermediate formed by reaction of CDI with a hydroxyl on the linker. A can also be a stable secondary amine linkage such as that formed by reductive alkylation of the amine on the peptide with an aldehyde or ketone group on the linker. A can also be a stable thioether linker formed using a maleimide or bromoacetamide in the linker with a thiol in the peptide, a triazole linker, a stable oxime linker, or a oxacarboline linker. B can be ($-CH2-$)$_x$- or a short PEG ($-CH_2CH_2O-$)$_x$ (x is 0-20) or other spacers or no spacer. C can be an amide bond formed with an amine or a carboxylic acid on the drug, a thioether formed between a maleimide on the linker and a sulfhydroyl on the drug, a secondary or tertiary amine, a carbamate, or other stable bonds. Any linker chemistry described in "Current ADC Linker Chemistry," Jain et al., Pharm Res, 2015 DOI 10.1007/si 1095-015-1657-7 can be used.

The resulting peptide conjugates can be administered to a human or animal subcutaneously, intravenously, orally, or injected directly into a joint to treat disease. The peptide is not specifically cleaved from the detectable agent or active agent via a targeted mechanism. The peptide can be degraded by mechanisms such as catabolism, releasing a drug that is modified or not modified form its native form (Antibody-Drug Conjugates: Design, Formulation, and Physicochemical Stability, Singh, Luisi, and Pak. Pharm Res (2015) 32:3541-3571). The peptide drug conjugate exerts its pharmacological activity while still intact, or while partially or fully degraded, metabolized, or catabolized.

In some embodiments, peptide conjugates can have cleavable linkers. In some embodiments, a peptide and drug can be conjugated via a linker and can be described with the formula Peptide-A-B-C-Drug, wherein the linker is A-B-C. In some embodiments, A can be a stable amide link such as that formed by reacting an amine on the peptide with a linker containing a tetrafluorophenyl (TFP) ester or an NHS ester. In certain embodiments, A can also be a stable carbamate linker that is formed by an amine reaction on the peptide with an imidazole carbamate active intermediate formed by reaction of CDI with a hydroxyl on the linker. In other embodiments, A can also be a stable secondary amine linkage such as that formed by reductive alkylation of the amine on the peptide with an aldehyde or ketone group on the linker. In some embodiments, A can also be a stable thioether linker formed using a maleimide or bromoacetamide in the linker with a thiol in the peptide, a triazole linker, a stable oxime linker, or an oxacarboline linker. B can be (—CH2-)$_x$- or a short PEG (—CH$_2$CH$_2$O—)$_x$ (x is 0-20) or other spacers or no spacer. C can be an ester bond to the hydroxyl or carboxylic acid on the drug, or a carbonate, hydrazone, or acylhydrazone, designed for hydrolytic cleavage. The hydrolytic rate of cleavage can be varied by varying the local environment around the bond, including carbon length (—CH2-)x, steric hindrance (including adjacent side groups such as methyl, ethyl, cyclic), hydrophilicity or hydrophobicity. In some embodiments, peptide conjugates can have a linear or cyclic ester linkage, which can include or do not include side chains such as methyl or ethyl groups. A linear ester linkage can be more susceptible to cleavage (such as by hydrolysis, an enzyme such as esterase, or other chemical reaction) than a cyclic ester due to steric hindrance or hydrophobicity/hydrophilicity effects. Likewise, side chains such as methyl or ethyl groups on the linear ester linkage can optionally make the linkage less susceptible to cleavage than without the side chains. In some embodiments, hydrolysis rate can be affected by local pH, such as lower pH in certain compartments of the body or of the cell such as endosomes and lysosomes or diseased tissues. In some embodiments, C can also be a pH sensitive group such as a hydrazone or oxime linkage. In other embodiments, C can be a disulfide bond designed to be released by reduction, such as by glutathione. In other embodiments, (or A-B-C) can be a peptidic linkage design for cleavable by enzymes. Optionally, a self-immolating group such as pABC can be included to cause release of a free unmodified drug upon cleavage (Antibody-Drug Conjugates: Design, Formulation, and Physicochemical Stability, Singh, Luisi, and Pak. Pharm Res (2015) 32:3541-3571). The linker can be cleaved by enzymes such as esterases, matrix metalloproteinases, cathepsins such as cathepsin B, glucuronidases, a protease, or thrombin. Alternatively, the bond designed for cleavage can be at A, rather than C, and C can be a stable bond or a cleavable bond. An alternative design can be to have stable linkers (such as amide or carbamate) at A and C and have a cleavable linker in B, such as a disulfide bond. The rate of reduction can be modulated by local effects such as steric hindrance from methyl or ethyl groups or modulating hydrophobicity/hydrophilicity. In some embodiments, peptide conjugates can have an ester carbonyl linkage, a long hydrocarbon linker, or carbamate linker, each of which can include hydrophilic groups, such as alcohols, acids, or ethers, or include a hydrocarbon side chain or other moiety that tunes the rate of cleavage. For example, the rate of hydrolysis can be faster with hydrophilic groups, such as alcohols, acids, or ethers, near an ester carbonyl. In another example, hydrophobic groups present as side chains or as a longer hydrocarbon linker can slow the cleavage rate of the ester. Likewise, cleavage of a carbamate group can also be tuned by hindrance, hydrophobicity, and the like. In another example, using a less labile linking group, such as a carbamate rather than an ester, can slow the cleavage rate of the linker.

Non-limiting examples of linkers include:

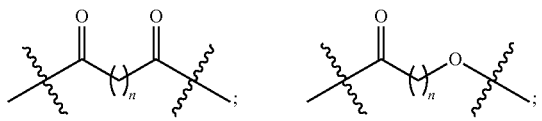

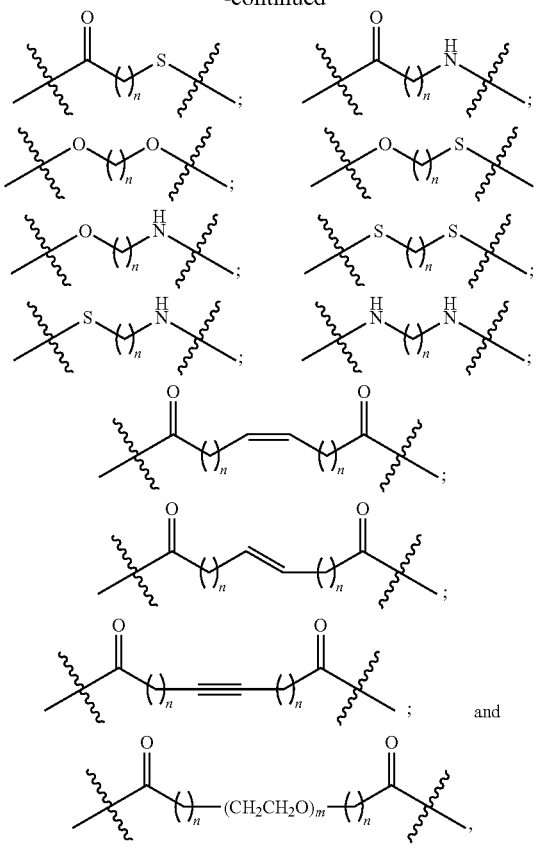

wherein each n is independently 0 to about 1,000; 1 to about 1,000; 0 to about 500; 1 to about 500; 0 to about 250; 1 to about 250; 0 to about 200; 1 to about 200; 0 to about 150; 1 to about 150; 0 to about 100; 1 to about 100; 0 to about 50; 1 to about 50; 0 to about 40; 1 to about 40; 0 to about 30; 1 to about 30; 0 to about 25; 1 to about 25; 0 to about 20; 1 to about 20; 0 to about 15; 1 to about 15; 0 to about 10; 1 to about 10; 0 to about 5; or 1 to about 5. In some embodiments, each n is independently 0, about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 31, about 32, about 33, about 34, about 35, about 36, about 37, about 38, about 39, about 40, about 41, about 42, about 43, about 44, about 45, about 46, about 47, about 48, about 49, or about 50. In some embodiments, m is 1 to about 1,000; 1 to about 500; 1 to about 250; 1 to about 200; 1 to about 150; 1 to about 100; 1 to about 50; 1 to about 40; 1 to about 30; 1 to about 25; 1 to about 20; 1 to about 15; 1 to about 10; or 1 to about 5. In some embodiments, m is 0, about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 31, about 32, about 33, about 34, about 35, about 36, about 37, about 38, about 39, about 40, about 41, about 42, about 43, about 44, about 45, about 46, about 47, about 48, about 49, or about 50.

In some cases a linker can be a succinic linker, and a drug can be attached to a peptide via an ester bond or an amide bond with two methylene carbons in between. In other cases, a linker can be any linker with both a hydroxyl group and a carboxylic acid, such as hydroxy hexanoic acid or lactic acid.

The linker can be a cleavable or a stable linker. The use of a cleavable linker permits release of the conjugated moiety (e.g., a therapeutic agent) from the peptide, e.g., after targeting to the cartilage. In some cases the linker is enzyme cleavable, e.g., a valine-citrulline linker. In some embodiments, the linker contains a self-immolating portion. In other embodiments, the linker includes one or more cleavage sites for a specific protease, such as a cleavage site for matrix metalloproteases (MMPs), thrombin, or cathepsin. Alternatively or in combination, the linker is cleavable by other mechanisms, such as via pH, reduction, or hydrolysis. A hydrolytically labile linker, (amongst other cleavable linkers described herein) can be advantageous in terms of releasing active agents from the peptide. For example, an active agent in a conjugate form with the peptide may not be active, but upon release from the conjugate after targeting to the cartilage, the active agent is active.

The rate of hydrolysis of the linker can be tuned. For example, the rate of hydrolysis of linkers with unhindered esters is faster compared to the hydrolysis of linkers with bulky groups next an ester carbonyl. A bulky group can be a methyl group, an ethyl group, a phenyl group, a ring, or an isopropyl group, or any group that provides steric bulk. In some cases, the steric bulk can be provided by the drug itself, such as by ketorolac when conjugated via its carboxylic acid. The rate of hydrolysis of the linker can be tuned according to the residency time of the conjugate in the cartilage. For example, when a peptide is cleared from the cartilage relatively quickly, the linker can be tuned to rapidly hydrolyze. In contrast, for example, when a peptide has a longer residence time in the cartilage, a slower hydrolysis rate can allow for extended delivery of an active agent. This can be important when the peptide is used to deliver a drug to the cartilage. "Programmed hydrolysis in designing paclitaxel prodrug for nanocarrier assembly" Sci Rep 2015, 5, 12023 Fu et al., provides an example of modified hydrolysis rates.

Peptide Stability

A peptide of the present disclosure can be stable in various biological conditions, as well as during manufacturing, handling, storage, and other conditions in either a liquid or a dried state. Additionally, a peptide of the present disclosure can be resistant to enzymatic cleavage needed for peptide processing by the immune system. For example, any peptide of SEQ ID NO: 485-SEQ ID NO: 1048 can exhibit resistance to reducing agents, proteases, oxidative conditions, or acidic conditions.

In some cases, biologic molecules (such as peptides and proteins) can provide therapeutic functions, but such therapeutic functions are decreased or impeded by instability caused by the in vivo environment. (Moroz et al., *Adv Drug Deliv Rev* 101:108-21 (2016), Mitragotri et al., *Nat Rev Drug Discov* 13(9):655-72 (2014), Bruno et al., *Ther Deliv* (11):1443-67 (2013), Sinha et al., *Crit Rev Ther Drug Carrier Syst.* 24(1):63-92 (2007), Hamman et al., *BioDrugs* 19(3):165-77 (2005)). Peptide degradation can be a result of a number of processes involving hydrolytic pathways, peptide oxidation such as oxidation of methionine (Met) residues, deamidation of asparagine (Asn) and glutamine (Gln) residues, and isomerization and hydrolysis of an adjacent asparagine (Asp) residue. (Manning et al., *Pharmaceutical Research*, Vol. 27 No. 4 (2010)). The amino acid immediately following the Asn or Gln residue can also affect the rate of deamidation, whereas: Asn-Gly, Asn-Ser, Asn-His, and Gln-Gly can be more likely to undergo deamidation. Additionally, the peptide bond adjacent to amino acids such as Asp can undergo hydrolysis with amino acid pairings such as Asp-Gly, Asp-Ser, Asp-Tyr, and Asp-Pro, which can be more likely to undergo hydrolysis. Oxidation of amino acid residues such as Met can form a sulfoxide species. The specific degradation reactions rates can vary for any given peptide or protein sequence.

Furthermore, the microenvironment within the molecular structure of the peptide, solvent accessibility, and conformational stability of each residue can impact the likelihood of peptide degradation. Therefore, by modifying a peptide sequence to reduce occurrence of such degradation events, a the modified peptide or peptide-conjugate can have increased beneficial properties over unmodified peptides or peptide-drug conjugates, such as improved therapeutic efficacy, an increased safety profile, and can be less expensive to manufacture and develop. Key formulaic considerations that can prevent peptide decay can include the use of excipients, formulation at a desired pH, and storage under specific conditions (e.g., temperature, oxygen, light exposure, solid or liquid state, and container excipient materials). To circumvent degradation, peptide residues can be substituted with amino acids that increase stability, which can result in more efficacious and durable therapeutic peptides.

With respect to in vivo stability, the GI tract can contain a region of low pH (e.g., pH ~1), a reducing environment, or a protease-rich environment that can degrade peptides and proteins. Proteolytic activity in other areas of the body, such as the mouth, eye, lung, intranasal cavity, joint, skin, vaginal tract, mucous membranes, and serum, can also be an obstacle to the delivery of functionally active peptides and polypeptides. Additionally, the half-life of peptides in serum can be very short, in part due to proteases, such that the peptide can be degraded too quickly to have a lasting therapeutic effect when administering a therapeutic and safe dosing regimen. Likewise, proteolytic activity in cellular compartments, such as lysosomes, and reduction activity in lysosomes and the cytosol can degrade peptides and proteins such that they may be unable to provide a therapeutic function on intracellular targets. Therefore, peptides that are resistant to reducing agents, proteases, and low pH may be able to provide enhanced therapeutic effects or enhance the therapeutic efficacy of co-formulated or conjugated active agents in vivo.

Additionally, oral delivery of drugs can be desirable in order to target certain areas of the body (e.g., disease in the GI tract such as colon cancer, irritable bowel disorder, infections, metabolic disorders, and constipation) despite the obstacles to the delivery of functionally active peptides and polypeptides presented by this method of administration. For example, oral delivery of drugs can increase compliance by providing a dosage form that is more convenient for patients to take as compared to parenteral delivery. Oral delivery can be useful in treatment regimens that have a large therapeutic window. Therefore, peptides that are resistant to reducing agents, proteases, and low pH can allow for oral delivery of peptides without nullifying their therapeutic function.

Peptide Resistance to Reducing Agents. Peptides of this disclosure can contain one or more cysteines, which can participate in disulfide bridges that can be integral to preserving the folded state of the peptide. Exposure of peptides to biological environments with reducing agents can result in unfolding of the peptide and loss of functionality and bioactivity. For example, glutathione (GSH) is a reducing agent that can be present in many areas of the body and in cells, and can reduce disulfide bonds. As another example, a peptide can become reduced upon cellular internalization during trafficking of a peptide across the gastrointestinal epithelium after oral administration a peptide can become reduced upon exposure to various parts of the GI tract. The GI tract can be a reducing environment, which can inhibit the ability of therapeutic molecules with disulfide bonds to have optimal therapeutic efficacy, due to reduction of the disulfide bonds. A peptide can also be reduced upon entry into a cell, such as after internalization by endosomes or lysosomes or into the cytosol, or other cellular compartments. Reduction of the disulfide bonds and unfolding of the peptide can lead to loss of functionality or affect key pharmacokinetic parameters such as bioavailability, peak plasma concentration, bioactivity, and half-life. Reduction of the disulfide bonds can also lead to increased susceptibility of the peptide to subsequent degradation by proteases, resulting in rapid loss of intact peptide after administration. In some embodiments, a peptide that is resistant to reduction can remain intact and can impart a functional activity for a longer period of time in various compartments of the body and in cells, as compared to a peptide that is more readily reduced.

In certain embodiments, the peptides of this disclosure can be analyzed for the characteristic of resistance to reducing agents to identify stable peptides. In some embodiments, the peptides of this disclosure can remain intact after being exposed to different molarities of reducing agents such as 0.00001M-0.0001M, 0.0001M-0.001M, 0.001M-0.01M, 0.01 M-0.05 M, 0.05 M-0.1 M, for greater 15 minutes or more. In some embodiments, the reducing agent used to determine peptide stability can be dithiothreitol (DTT), Tris (2-carboxyethyl) phosphine HCl (TCEP), 2-Mercaptoethanol, (reduced) glutathione (GSH), or any combination thereof. In some embodiments, at least 5%-10%, at least 10%-20%, at least 20%-30%, at least 30%-40%, at least 40%-50%, at least 50%-60%, at least 60%-70%, at least 70%-80%, at least 80%-90%, or at least 90%-100% of the peptide remains intact after exposure to a reducing agent.

Peptide Resistance to Proteases. The stability of peptides of this disclosure can be determined by resistance to degradation by proteases. Proteases, also referred to as peptidases or proteinases, can be enzymes that can degrade peptides and proteins by breaking bonds between adjacent amino acids. Families of proteases with specificity for targeting specific amino acids can include serine proteases, cysteine proteases, threonine proteases, aspartic proteases, glutamic proteases, esterases, serum proteases, and asparagine proteases. Additionally, metalloproteases, matrix metalloproteases, elastase, carboxypeptidases, Cytochrome P450 enzymes, and cathepsins can also digest peptides and proteins. Proteases can be present at high concentration in blood, in mucous membranes, lungs, skin, the GI tract, the mouth, nose, eye, and in compartments of the cell. Misregulation of proteases can also be present in various diseases such as rheumatoid arthritis and other immune disorders. Degradation by proteases can reduce bioavailability, biodistribution, half-life, and bioactivity of therapeutic molecules such that they are unable to perform their therapeutic function. In some embodiments, peptides that are resistant to proteases can better provide therapeutic activity at reasonably tolerated concentrations in vivo.

In some embodiments, peptides of this disclosure can resist degradation by any class of protease. In certain embodiments, peptides of this disclosure resist degradation by pepsin (which can be found in the stomach), trypsin (which can be found in the duodenum), serum proteases, or any combination thereof. In certain embodiments, peptides of this disclosure can resist degradation by lung proteases (e.g., serine, cysteinyl, and aspartyl proteases, metalloproteases, neutrophil elastase, alpha-1 antitrypsin, secretory leucoprotease inhibitor, elafin), or any combination thereof. In some embodiments, the proteases used to determine peptide stability can be pepsin, trypsin, chymotrypsin, or any combination thereof. In some embodiments, at least 5%-10%, at least 10%-20%, at least 20%-30%, at least 30%-40%, at least 40%-50%, at least 50%-60%, at least 60%-70%, at least 70%-80%, at least 80%-90%, or at least 90%-100% of the peptide remains intact after exposure to a protease. Peptides of SEQ ID NO: 683, SEQ ID NO: 511, and SEQ ID NO: 592 can have particular structural qualities, which make them more resistant to protease degradation. For example, peptide of SEQ ID NO: 511 and SEQ ID NO: 593 exhibit the "hitchin" topology as described previously, which can be associated with resistance to protease and chemical degradation.

Peptide Stability in Acidic Conditions. Peptides of this disclosure can be administered in biological environments that are acidic. For example, after oral administration, peptides can experience acidic environmental conditions in the gastric fluids of the stomach and gastrointestinal (GI) tract. The pH of the stomach can range from ~1-4 and the pH of the GI tract ranges from acidic to normal physiological pH descending from the upper GI tract to the colon. In addition, the vagina, late endosomes, and lysosomes can also have acidic pH values, such as less than pH 7. These acidic conditions can lead to denaturation of peptides and proteins into unfolded states. Unfolding of peptides and proteins can lead to increased susceptibility to subsequent digestion by other enzymes as well as loss of biological activity of the peptide.

In certain embodiments, the peptides of this disclosure can resist denaturation and degradation in acidic conditions and in buffers, which simulate acidic conditions. In certain embodiments, peptides of this disclosure can resist denaturation or degradation in buffer with a pH less than 1, a pH less than 2, a pH less than 3, a pH less than 4, a pH less than 5, a pH less than 6, a pH less than 7, or a pH less than 8. In some embodiments, peptides of this disclosure remain intact at a pH of 1-3. In certain embodiments, at least 5%-10%, at least 10%-20%, at least 20%-30%, at least 30%-40%, at least 40%-50%, at least 50%-60%, at least 60%-70%, at least 70%-80%, at least 80%-90%, or at least 90%-100% of the peptide remains intact after exposure to a buffer with a pH less than 1, a pH less than 2, a pH less than 3, a pH less than 4, a pH less than 5, a pH less than 6, a pH less than 7, or a pH less than 8. In other embodiments, at least 5%-10%, at least 10%-20%, at least 20%-30%, at least 30%-40%, at least 40%-50%, at least 50%-60%, at least 60%-70%, at least 70%-80%, at least 80%-90%, or at least 90%-100% of the peptide remains intact after exposure to a buffer with a pH of 1-3. In other embodiments, the peptides of this disclosure can be resistant to denaturation or degradation in simulated gastric fluid (pH 1-2). In some embodiments, at least 5-10%, at least 10%-20%, at least 20%-30%, at least 30%-40%, at least 40%-50%, at least 50%-60%, at least 60%-70%, at least 70%-80%, at least 80%-90%, or at least 90-100% of the peptide remains intact after exposure to simulated gastric fluid. In some embodiments, low pH solutions such as simulated gastric fluid or citrate buffers can be used to determine peptide stability.

Peptide Stability at High Temperatures. Peptides of this disclosure can be administered in biological environments with high temperatures. For example, after oral administration, peptides can experience high temperatures in the body. Body temperature can range from 36° C. to 40° C. High temperatures can lead to denaturation of peptides and proteins into unfolded states. Unfolding of peptides and proteins can lead to increased susceptibility to subsequent digestion by other enzymes as well as loss of biological activity of the peptide. In some embodiments, a peptide of this disclosure can remain intact at temperatures from 25° C. to 100° C. High temperatures can lead to faster degradation of peptides. Stability at a higher temperature can allow for storage of the peptide in tropical environments or areas where access to refrigeration is limited. In certain embodiments, 5%-100% of the peptide can remain intact after exposure to 25° C. for 6 months to 5 years. 5%-100% of a peptide can remain intact after exposure to 70° C. for 15 minutes to 1 hour. 5%-100% of a peptide can remain intact after exposure to 100° C. for 15 minutes to 1 hour. In other embodiments, at least 5%-10%, at least 10%-20%, at least 20%-30%, at least 30%-40%, at least 40%-50%, at least 50%-60%, at least 60%-70%, at least 70%-80%, at least 80%-90%, or at least 90%-100% of the peptide remains intact after exposure to 25° C. for 6 months to 5 years. In other embodiments, at least 5%-10%, at least 10%-20%, at least 20%-30%, at least 30%-40%, at least 40%-50%, at least 50%-60%, at least 60%-70%, at least 70%-80%, at least 80%-90%, or at least 90%-100% of the peptide remains intact after exposure to 70° C. for 15 minutes to 1 hour. In other embodiments, at least 5%-10%, at least 10%-20%, at least 20%-30%, at least 30%-40%, at least 40%-50%, at least 50%-60%, at least 60%-70%, at least 70%-80%, at least 80%-90%, or at least 90%-100% of the peptide remains intact after exposure to 100° C. for 15 minutes to 1 hour.

In some embodiments, the peptide of the peptide active agent conjugate comprises a sequence that has at least 75%, at least 80%, at least 85%, at least 90%, at least 95%, at least 97%, at least 99% or 100% sequence identity with any one of SEQ ID NO: 508-SEQ ID NO: 758 or a fragment thereof. In some embodiments, the peptide of the peptide active agent conjugate comprises a sequence that has at least 75%, at least 80%, at least 85%, at least 90%, at least 95%, at least 97%, at least 99% or 100% sequence identity with any one of SEQ ID NO: 744-SEQ ID NO: 758 or a fragment thereof. In some embodiments, the peptide of the peptide active agent conjugate comprises a sequence that has at least 75%, at least 80%, at least 85%, at least 90%, at least 95%, at least 97%, at least 99% or 100% sequence identity with any one of SEQ ID NO: 798-SEQ ID NO: 1048 or a fragment thereof. In some embodiments, the peptide of the peptide active agent conjugate comprises a sequence that has at least 75%, at least 80%, at least 85%, at least 90%, at least 95%, at least 97%, at least 99% or 100% sequence identity with any one of SEQ ID NO: 1034-SEQ ID NO: 1048 or a fragment thereof. In some embodiments, the peptide of the peptide active agent conjugate comprises a sequence of any one of SEQ ID NO: 508-SEQ ID NO: 758 or a fragment thereof. In some embodiments, the peptide of the peptide active agent conjugate comprises a sequence of any one of SEQ ID NO: 744-SEQ ID NO: 758 or a fragment thereof. In some embodiments, the peptide of the peptide active agent conjugate comprises a sequence of any one of SEQ ID NO: 798-SEQ ID NO: 1048 or a fragment thereof. In some embodiments, the peptide of the peptide active agent conjugate comprises a sequence of any one of SEQ ID NO: 1034-SEQ ID NO: 1048 or a fragment thereof. In some embodiments, the peptide comprises a sequence that has at least 70%, at least 75%, at least 80%, at least 85%, at least 90%, at least 95%, at least 97%, at least 99%, or 100% sequence identity with any one of SEQ ID NO: 744-SEQ ID NO: 758. In some embodiments, the peptide comprises at least 70%, at least 75%, at least 80%, at least 85%, at least 90%, at least 95%, at least 97%, at least 99%, or 100% sequence identity with any one of SEQ ID NO: 1034-SEQ ID NO: 1048. In some embodiments, the peptide active agent conjugate or the peptide comprises a sequence of any one of SEQ ID NO: 485-SEQ ID NO: 507 or a fragment thereof. In some embodiments, the peptide active agent conjugate or the peptide comprises a sequence of any one of SEQ ID NO: 759-SEQ ID NO: 781 or a fragment thereof. In some embodiments, the peptide active agent conjugate or the peptide comprises a sequence of any one of SEQ ID NO: 505-SEQ ID NO: 507 or a fragment thereof. In some embodiments, the peptide active agent conjugate or the peptide comprises a sequence of any one of SEQ ID NO: 779-SEQ ID NO: 781 or a fragment thereof. In some embodiments, the peptide active agent conjugate or the peptide comprises a peptide with at least 30%, at least 40%, at least 50%, at least 60%, at least 70%, at least 80%, at least 90%, at least 95%, at least, 97%, at least 98%, or at least 99% identical to any one of SEQ ID NO: 978-SEQ ID NO: 1024 or at least 30%, at least 40%, at least 50%, at least 60%, at least 70%, at least 80%, at least 90%, at least 95%, at least 97%, at least 98%, or at least 99% identical to any one of SEQ ID NO: 688-SEQ ID NO: 734.

Pharmacokinetics of Peptides

The pharmacokinetics of any of the peptides of this disclosure can be determined after administration of the peptide via different routes of administration. For example, the pharmacokinetic parameters of a peptide of this disclosure can be quantified after intravenous, subcutaneous, intramuscular, rectal, aerosol, parenteral, ophthalmic, pulmonary, transdermal, vaginal, optic, nasal, oral, sublingual, inhalation, dermal, intrathecal, intranasal, intra-articular, peritoneal, buccal, synovial, or topical administration. Peptides of the present disclosure can be analyzed by using tracking agents such as radiolabels or fluorophores. For example, a radiolabeled peptide of this disclosure can be administered via various routes of administration. Peptide concentration or dose recovery in various biological samples such as plasma, urine, feces, any organ, skin, muscle, and other tissues can be determined using a range of methods including HPLC, fluorescence detection techniques (TECAN quantification, flow cytometry, iVIS), or liquid scintillation counting.

The methods and compositions described herein can relate to pharmacokinetics of peptide administration via any route to a subject. Pharmacokinetics can be described using methods and models, for example, compartmental models or noncompartmental methods. Compartmental models include but are not limited to monocompartmental model, the two compartmental model, the multicompartmental model or the like. Models can be divided into different compartments and can be described by the corresponding scheme. For example, one scheme is the absorption, distribution, metabolism and excretion (ADME) scheme. For another example, another scheme is the liberation, absorption, distribution, metabolism and excretion (LADME) scheme. In some aspects, metabolism and excretion can be grouped into one compartment referred to as the elimination compartment. For example, liberation can include liberation of the active portion of the composition from the delivery system, absorption includes absorption of the active portion of the composition by the subject, distribution includes distribution of the composition through the blood plasma and to different tissues, metabolism, which includes metabolism or inactivation of the composition and finally excretion, which includes excretion or elimination of the composition or the products of metabolism of the composition. Compositions administered intravenously to a subject can be subject to multiphasic pharmacokinetic profiles, which can include but are not limited to aspects of tissue distribution and metabolism/excretion. As such, the decrease in plasma or serum concentration of the composition is often biphasic, including, for example an alpha phase and a beta phase, occasionally a gamma, delta or other phase is observed Pharmacokinetics includes determining at least one parameter associated with administration of a peptide to a subject. In some aspects, parameters include at least the dose (D), dosing interval (i), area under curve (AUC), maximum concentration ($C_{max}$), minimum concentration reached before a subsequent dose is administered ($C_{min}$), minimum time ($T_{min}$), maximum time to reach $C_{max}$ ($T_{max}$), volume of distribution ($V_d$), steady-state volume of distribution ($V_{ss}$), back-extrapolated concentration at time 0 ($C_0$), steady state concentration ($C_{ss}$), elimination rate constant ($k_e$), infusion rate ($k_{in}$), clearance (CL), bioavailability (f), fluctuation (% PTF) and elimination half-life ($t_{1/2}$).

In certain embodiments, the peptides of any of SEQ ID NO: 485-SEQ ID NO: 1048 exhibit optimal pharmacokinetic parameters after oral administration. In other embodiments, the peptides of any of SEQ ID NO: 485-SEQ ID NO: 1048 exhibit optimal pharmacokinetic parameters after any route of administration, such as oral administration, inhalation, intranasal administration, topical administration, parenteral administration, intravenous administration, subcutaneous administration, intra-articular administration, intramuscular administration, intraperitoneal administration, transdermal administration, dermal administration, or any combination thereof.

In some embodiments any peptide of SEQ ID NO: 485-SEQ ID NO: 1048 exhibits an average $T_{max}$ of 0.5-12 hours, or 1-48 hours at which the $C_{max}$ is reached, an average bioavailability in serum of 0.1%-10% in the subject after administering the peptide to the subject by an oral route, an average bioavailability in serum of less than 0.10% after oral administration to a subject for delivery to the GI tract, an average bioavailability in serum of 10-100% after parenteral administration, an average $t_z$ of 0.1 hours-168 hours, or 0.25 hours-48 hours in a subject after administering the peptide to the subject, an average clearance (CL) of 0.5-100 L/hour or 0.5-50 L/hour of the peptide after administering the peptide to a subject, an average volume of distribution ($V_d$) of 200-20,000 mL in the subject after systemically administering the peptide to the subject, or optionally no systemic uptake, any combination thereof.

Methods of Manufacture

Various expression vector/host systems can be utilized for the production of the recombinant expression of peptides described herein. Non-limiting examples of such systems include microorganisms such as bacteria transformed with recombinant bacteriophage DNA, plasmid DNA or cosmid DNA expression vectors containing a nucleic acid sequence encoding peptides or peptide fusion proteins/chimeric proteins described herein, yeast transformed with recombinant yeast expression vectors containing the aforementioned nucleic acid sequence, insect cell systems infected with recombinant virus expression vectors (e.g., baculovirus) containing the aforementioned nucleic acid sequence, plant cell systems infected with recombinant virus expression vectors (e.g., cauliflower mosaic virus (CaMV), tobacco mosaic virus (TMV) or transformed with recombinant plasmid expression vectors (e.g., Ti plasmid) containing the aforementioned nucleic acid sequence, or animal cell systems infected with recombinant virus expression vectors (e.g., adenovirus, vaccinia virus) including cell lines engineered to contain multiple copies of the aforementioned nucleic acid sequence, either stably amplified (e.g., CHO/dhfr, CHO/glutamine synthetase) or unstably amplified in double-minute chromosomes (e.g., murine cell lines). Disulfide bond formation and folding of the peptide could occur during expression or after expression or both.

A host cell can be adapted to express one or more peptides described herein. The host cells can be prokaryotic, eukaryotic, or insect cells. In some cases, host cells are capable of modulating the expression of the inserted sequences, or modifying and processing the gene or protein product in the specific fashion desired. For example, expression from certain promoters can be elevated in the presence of certain inducers (e.g., zinc and cadmium ions for metallothionine promoters). In some cases, modifications (e.g., phosphorylation) and processing (e.g., cleavage) of peptide products can be important for the function of the peptide. Host cells can have characteristic and specific mechanisms for the post-translational processing and modification of a peptide. In some cases, the host cells used to express the peptides secretes minimal amounts of proteolytic enzymes.

In the case of cell- or viral-based samples, organisms can be treated prior to purification to preserve and/or release a target polypeptide. In some embodiments, the cells are fixed using a fixing agent. In some embodiments, the cells are lysed. The cellular material can be treated in a manner that does not disrupt a significant proportion of cells, but which removes proteins from the surface of the cellular material, and/or from the interstices between cells. For example, cellular material can be soaked in a liquid buffer or, in the case of plant material, can be subjected to a vacuum, in order to remove proteins located in the intercellular spaces and/or in the plant cell wall. If the cellular material is a microorganism, proteins can be extracted from the microorganism culture medium. Alternatively, the peptides can be packed in inclusion bodies. The inclusion bodies can further be separated from the cellular components in the medium. In some embodiments, the cells are not disrupted. A cellular or viral peptide that is presented by a cell or virus can be used for the attachment and/or purification of intact cells or viral particles. In addition to recombinant systems, Peptides can also be synthesized in a cell-free system using a variety of known techniques employed in protein and peptide synthesis.

In some cases, a host cell produces a peptide that has an attachment point for a drug. An attachment point could comprise a lysine residue, an N-terminus, a cysteine residue, a cysteine disulfide bond, or a non-natural amino acid. The peptide could also be produced synthetically, such as by solid-phase peptide synthesis, or solution-phase peptide synthesis. The peptide could be folded (formation of disulfide bonds) during synthesis or after synthesis or both. Peptide fragments could be produced synthetically or recombinantly and then joined together synthetically, recombinantly, or via an enzyme.

Figure 36:
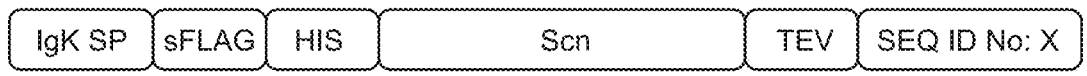
FIG. 36 illustrates an exemplary architecture of constructs expressing sequences of SEQ ID NO: X, where X can be any one of peptides of SEQ ID NO: 508-SEQ ID NO: 520.
Figure 37:
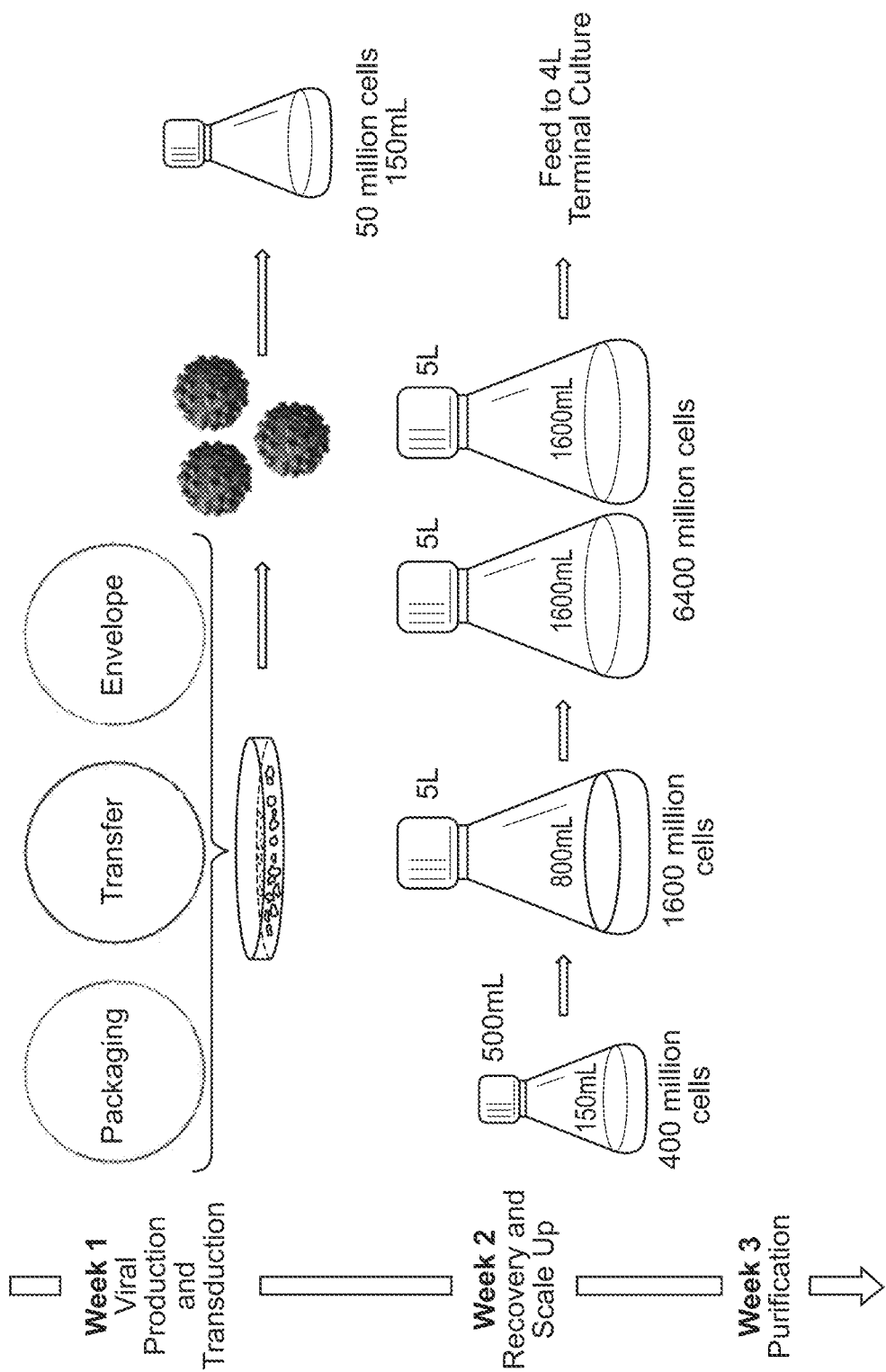
FIG. 37 illustrates a schematic of a method of manufacturing of a peptide of the disclosure.

FIG. 37 illustrates a schematic of a method of manufacturing a construct that expresses a peptide of the disclosure, such as the constructs illustrated in FIG. 36 and as described throughout the disclosure and in SEQ ID NO: 485-SEQ ID NO: 1048 provided herein.

In other aspects, the peptides of the present disclosure can be prepared by conventional solid phase chemical synthesis techniques, for example according to the Fmoc solid phase peptide synthesis method ("Fmoc solid phase peptide synthesis, a practical approach," edited by W. C. Chan and P. D. White, Oxford University Press, 2000), Boc solid phase peptide synthesis, or solution phase peptide synthesis. The disulfide bonds can be formed after cleavage from the resin, such as by air oxidation or a buffer system with a set pH range such as from 7-10 and can contain a redox system such as glutathione/oxidized glutathione or cysteine/cystine. The disulfide bonds can also be formed by selective protection and deprotection of specific cysteine residues followed by oxidation, or on the resin. The peptide can be purified, such as by reversed-phase chromatography at any one or more steps during the production process. The peptide can be isolated by lyophilization and can be in various salt forms, such as TFA salt or ammonium and acetate salt.

Pharmaceutical Compositions of Peptides

A pharmaceutical composition of the disclosure can be a combination of any peptide described herein with other chemical components, such as carriers, stabilizers, diluents, dispersing agents, suspending agents, thickening agents, antioxidants, solubilizers, buffers, osmolytes, salts, surfactants, amino acids, encapsulating agents, bulking agents, cryoprotectants, and/or excipients. The pharmaceutical composition facilitates administration of a peptide described herein to an organism. Pharmaceutical compositions can be administered in therapeutically-effective amounts as pharmaceutical compositions by various forms and routes including, for example, intravenous, subcutaneous, intramuscular, rectal, aerosol, parenteral, ophthalmic, pulmonary, transdermal, vaginal, optic, nasal, oral, sublingual, inhalation, dermal, intrathecal, intranasal, intra-articular, and topical administration. A pharmaceutical composition can be administered in a local or systemic manner, for example, via injection of the peptide described herein directly into an organ, optionally in a depot.

Parenteral injections can be formulated for bolus injection or continuous infusion. The pharmaceutical compositions can be in a form suitable for parenteral injection as a sterile suspension, solution or emulsion in oily or aqueous vehicles, and can contain formulatory agents such as suspending, stabilizing and/or dispersing agents. Pharmaceutical formulations for parenteral administration include aqueous solutions of a peptide described herein in water soluble form. Suspensions of peptides described herein can be prepared as oily injection suspensions. Suitable lipophilic solvents or vehicles include fatty oils such as sesame oil, or synthetic fatty acid esters, such as ethyl oleate or triglycerides, or liposomes. Aqueous injection suspensions can contain substances which increase the viscosity of the suspension, such as sodium carboxymethyl cellulose, sorbitol, or dextran. The suspension can also contain suitable stabilizers or agents which increase the solubility and/or reduce the aggregation of such peptides described herein to allow for the preparation of highly concentrated solutions. Alternatively, the peptides described herein can be lyophilized or in powder form for re-constitution with a suitable vehicle, e.g., sterile pyrogen-free water, before use. In some embodiments, a purified peptide is administered intravenously.

A peptide of the disclosure can be applied directly to an organ, or an organ tissue or cells, such as brain or brain tissue or cancer cells, during a surgical procedure. The recombinant peptides described herein can be administered topically and can be formulated into a variety of topically administrable compositions, such as solutions, suspensions, lotions, gels, pastes, medicated sticks, balms, creams, and ointments. Such pharmaceutical compositions can contain solubilizers, stabilizers, tonicity enhancing agents, buffers and preservatives.

In practicing the methods of treatment or use provided herein, therapeutically-effective amounts of the peptide described herein described herein can be administered in pharmaceutical compositions to a subject suffering from a condition that affects the immune system. In some embodiments, the subject is a mammal such as a human. A therapeutically-effective amount can vary widely depending on the severity of the disease, the age and relative health of the subject, the potency of the compounds used, and other factors.

Pharmaceutical compositions can be formulated using one or more physiologically-acceptable carriers comprising excipients and auxiliaries, which facilitate processing of the active compounds into preparations that can be used pharmaceutically. Formulation can be modified depending upon the route of administration chosen. Pharmaceutical compositions comprising a peptide described herein can be manufactured, for example, by expressing the peptide in a recombinant system, purifying the peptide, lyophilizing the peptide, mixing, dissolving, granulating, dragee-making, levigating, emulsifying, encapsulating, entrapping, or compression processes. The pharmaceutical compositions can include at least one pharmaceutically acceptable carrier, diluent, or excipient and compounds described herein as free-base or pharmaceutically-acceptable salt form.

Methods for the preparation of peptides described herein comprising the compounds described herein include formulating the peptide described herein with one or more inert, pharmaceutically-acceptable excipients or carriers to form a solid, semi-solid, or liquid composition. Solid compositions include, for example, powders, tablets, dispersible granules, capsules, cachets, and suppositories. These compositions can also contain minor amounts of nontoxic, auxiliary substances, such as wetting or emulsifying agents, pH buffering agents, and other pharmaceutically-acceptable additives.

Non-limiting examples of pharmaceutically-acceptable excipients can be found, for example, in Remington: The Science and Practice of Pharmacy, Nineteenth Ed (Easton, Pa.: Mack Publishing Company, 1995); Hoover, John E., Remington's Pharmaceutical Sciences, Mack Publishing Co., Easton, Pa. 1975; Liberman, H. A. and Lachman, L., Eds., Pharmaceutical Dosage Forms, Marcel Decker, New York, N.Y., 1980; and Pharmaceutical Dosage Forms and Drug Delivery Systems, Seventh Ed. (Lippincott Williams & Wilkins 1999), each of which is incorporated by reference in its entirety.

Administration of Pharmaceutical Compositions

A pharmaceutical composition of the disclosure can be a combination of any peptide described herein with other chemical components, such as carriers, stabilizers, diluents, dispersing agents, suspending agents, thickening agents, and/or excipients. The pharmaceutical composition facilitates administration of a peptide described herein to an organism. Pharmaceutical compositions can be administered in therapeutically-effective amounts as pharmaceutical compositions by various forms and routes including, for example, intravenous, subcutaneous, intramuscular, rectal, aerosol, parenteral, ophthalmic, pulmonary, transdermal, vaginal, optic, nasal, oral, inhalation, dermal, intra-articular, intrathecal, intranasal, and topical administration. A pharmaceutical composition can be administered in a local or systemic manner, for example, via injection of the peptide described herein directly into an organ, optionally in a depot.

Parenteral injections can be formulated for bolus injection or continuous infusion. The pharmaceutical compositions can be in a form suitable for parenteral injection as a sterile suspension, solution or emulsion in oily or aqueous vehicles, and can contain formulatory agents such as suspending, stabilizing and/or dispersing agents. Pharmaceutical formulations for parenteral administration include aqueous solutions of a peptide described herein in water-soluble form. Suspensions of peptides described herein can be prepared as oily injection suspensions. Suitable lipophilic solvents or vehicles include fatty oils such as sesame oil, or synthetic fatty acid esters, such as ethyl oleate or triglycerides, or liposomes. Aqueous injection suspensions can contain substances which increase the viscosity of the suspension, such as sodium carboxymethyl cellulose, sorbitol, or dextran. The suspension can also contain suitable stabilizers or agents which increase the solubility and/or reduce the aggregation of such peptides described herein to allow for the preparation of highly concentrated solutions. Alternatively, the peptides described herein can be lyophilized or in powder form for re-constitution with a suitable vehicle, e.g., sterile pyrogen-free water, before use. In some embodiments, a purified peptide is administered intravenously. A peptide described herein can be administered to a subject, home, target, migrates to, is retained by, and/or binds to, or be directed to an organ, e.g., the cartilage.

A peptide of the disclosure can be applied directly to an organ, or an organ tissue or cells, such as cartilage or cartilage tissue or cells, during a surgical procedure. The recombinant peptides described herein can be administered topically and can be formulated into a variety of topically administrable compositions, such as solutions, suspensions, lotions, gels, pastes, medicated sticks, balms, creams, and ointments. Such pharmaceutical compositions can contain solubilizers, stabilizers, tonicity enhancing agents, buffers and preservatives.

In practicing the methods of treatment or use provided herein, therapeutically-effective amounts of the peptide described herein described herein are administered in pharmaceutical compositions to a subject suffering from a condition. In some instances the pharmaceutical composition will affect the physiology of the animal, such as the immune system, inflammatory response, or other physiologic affect. In some embodiments, the subject is a mammal such as a human. A therapeutically-effective amount can vary widely depending on the severity of the disease, the age and relative health of the subject, the potency of the compounds used, and other factors.

Pharmaceutical compositions can be formulated using one or more physiologically-acceptable carriers comprising excipients and auxiliaries, which facilitate processing of the active compounds into preparations that can be used pharmaceutically. Formulation can be modified depending upon the route of administration chosen. Pharmaceutical compositions comprising a peptide described herein can be manufactured, for example, by expressing the peptide in a recombinant system, purifying the peptide, lyophilizing the peptide, mixing, dissolving, granulating, dragee-making, levigating, emulsifying, encapsulating, entrapping, or compression processes. The pharmaceutical compositions can include at least one pharmaceutically acceptable carrier, diluent, or excipient and compounds described herein as free-base or pharmaceutically-acceptable salt form.

Methods for the preparation of peptides described herein comprising the compounds described herein include formulating the peptide described herein with one or more inert, pharmaceutically-acceptable excipients or carriers to form a solid, semi-solid, or liquid composition. Solid compositions include, for example, powders, tablets, dispersible granules, capsules, cachets, and suppositories. These compositions can also contain minor amounts of nontoxic, auxiliary substances, such as wetting or emulsifying agents, pH buffering agents, and other pharmaceutically-acceptable additives.

Non-limiting examples of pharmaceutically-acceptable excipients can be found, for example, in *Remington: The Science and Practice of Pharmacy*, Nineteenth Ed (Easton, Pa.: Mack Publishing Company, 1995); Hoover, John E., *Remington's Pharmaceutical Sciences*, Mack Publishing Co., Easton, Pa. 1975; Liberman, H. A. and Lachman, L., Eds., *Pharmaceutical Dosage Forms*, Marcel Decker, New York, N.Y., 1980; and *Pharmaceutical Dosage Forms and Drug Delivery Systems*, Seventh Ed. (Lippincott Williams & Wilkins 1999), each of which is incorporated by reference in its entirety.

Use of Peptide in Imaging and Surgical Methods

The present disclosure generally relates to peptides that home, target, migrate to, are retained by, accumulate in, and/or bind to, or are directed to specific regions, tissues, structures, or cells within the body and methods of using such peptides. These peptides have the ability to contact the cartilage, which makes them useful for a variety of applications. In particular, the peptides can have applications in site-specific modulation of biomolecules to which the peptides are directed to. End uses of such peptides can include, for example, imaging, research, therapeutics, theranostics, pharmaceuticals, chemotherapy, chelation therapy, targeted drug delivery, and radiotherapy. Some uses can include targeted drug delivery and imaging.

In some embodiments, the present disclosure provides a method for detecting a cancer, cancerous tissue, or tumor tissue, the method comprising the steps of contacting a tissue of interest with a peptide of the present disclosure, wherein the peptide is conjugated to a detectable agent and measuring the level of binding of the peptide, wherein an elevated level of binding, relative to normal tissue, is indicative that the tissue is a cancer, cancerous tissue or tumor tissue.

In some embodiments, the disclosure provides a method of imaging an organ or body region or region, tissue or structure of a subject, the method comprising administrating to the subject the peptide or a pharmaceutical composition disclosed herein and imaging the subject. In some embodiments such imaging is used to detect a condition associated with cartilage, or a function of the cartilage. In some cases the condition is an inflammation, a cancer, a degradation, a growth disturbance, genetic, a tear or an injury, or another suitable condition. In some cases the condition is a chondrodystrophy, a traumatic rupture or detachment, pain following surgery in regions of the body containing cartilage, costochondritis, herniation, polychondritis, arthritis, osteoarthritis, rheumatoid arthritis, ankylosing spondylitis (AS), Systemic Lupus Erythematosus (SLE or "Lupus"), Psoriatic Arthritis (PsA), gout, achondroplasia, or another suitable condition. In some case the condition is associated with a cancer or tumor of the cartilage. In some cases the condition is a type of chondroma or chondrosarcoma, whether metastatic or not, or another suitable condition. In some embodiments, such as those associated with cancers, the imaging may be associated with surgical removal of the diseased region, tissue, structure or cell of a subject.

Furthermore, the present disclosure provides methods for intraoperative imaging and resection of a diseased or inflamed tissue, cancer, cancerous tissue, or tumor tissue using a peptide of the present disclosure conjugated with a detectable agent. In some embodiments, the diseased or inflamed tissue, cancer, cancerous tissue, or tumor tissue is detectable by fluorescence imaging that allows for intraoperative visualization of the cancer, cancerous tissue, or tumor tissue using a peptide of the present disclosure. In some embodiments, the peptide of the present disclosure is conjugated to one or more detectable agents. In a further embodiment, the detectable agent comprises a fluorescent moiety coupled to the peptide. In another embodiment, the detectable agent comprises a radionuclide. In some embodiments, imaging is achieved during open surgery. In further embodiments, imaging is accomplished using endoscopy or other non-invasive surgical techniques.

Treatment of Cartilage Disorders

The term "effective amount," as used herein, can refer to a sufficient amount of an agent or a compound being administered which will relieve to some extent one or more of the symptoms of the disease or condition being treated. The result can be reduction and/or alleviation of the signs, symptoms, or causes of a disease, or any other desired alteration of a biological system. Compositions containing such agents or compounds can be administered for prophylactic, enhancing, and/or therapeutic treatments. An appropriate "effective" amount in any individual case can be determined using techniques, such as a dose escalation study.

The methods, compositions, and kits of this disclosure can comprise a method to prevent, treat, arrest, reverse, or ameliorate the symptoms of a condition. The treatment can comprise treating a subject (e.g., an individual, a domestic animal, a wild animal or a lab animal afflicted with a disease or condition) with a peptide of the disclosure. In treating a disease, the peptide can contact the cartilage of a subject. The subject can be a human. A subject can be a human; a non-human primate such as a chimpanzee, or other ape or monkey species; a farm animal such as a cattle, horse, sheep, goat, swine; a domestic animal such as a rabbit, dog, and cat; a laboratory animal including a rodent, such as a rat, mouse and guinea pig, or the like. A subject can be of any age. A subject can be, for example, an elderly adult, adult, adolescent, pre-adolescent, child, toddler, infant, or fetus in utero.

Treatment can be provided to the subject before clinical onset of disease. Treatment can be provided to the subject after clinical onset of disease. Treatment can be provided to the subject after 1 day, 1 week, 6 months, 12 months, or 2 years or more after clinical onset of the disease. Treatment may be provided to the subject for more than 1 day, 1 week, 1 month, 6 months, 12 months, 2 years or more after clinical onset of disease. Treatment may be provided to the subject for less than 1 day, 1 week, 1 month, 6 months, 12 months, or 2 years after clinical onset of the disease. Treatment can also include treating a human in a clinical trial. A treatment can comprise administering to a subject a pharmaceutical composition, such as one or more of the pharmaceutical compositions described throughout the disclosure. A treatment can comprise a once daily dosing. A treatment can comprise delivering a peptide of the disclosure to a subject, either parenterally, intravenously, subcutaneously, intramuscularly, by inhalation, dermally, intra-articular injection, orally, intrathecally, transdermally, intranasally, via a peritoneal route, or directly onto or into a joint, e.g., via topical, intra-articular injection route or injection route of application. A treatment can comprise administering a peptide-active agent complex to a subject, either parenterally, intravenously, subcutaneously, intramuscularly, by inhalation, dermally, intra-articular injection, orally, intrathecally, transdermally, intranasally, via a peritoneal route, or directly onto or into a joint or directly onto, near or into the cartilage, e.g., via topical, intra-articular injection route or injection route of application.

Types of cartilage diseases or conditions that can be treated with a peptide of the disclosure can include inflammation, pain management, anti-infective, pain relief, anti-cytokine, cancer, injury, degradation, genetic basis, remodeling, hyperplasia, surgical injury/trauma, or the like. Diseases or conditions of bone adjacent to cartilage can also be treated with a peptide of the disclosure. Examples of cartilage diseases or conditions that can be treated with a peptide of the disclosure include Costochondritis, Spinal disc herniation, Relapsing polychondritis, Injury to the articular cartilage, any manner of rheumatic disease (e.g., Rheumatoid Arthritis (RA), ankylosing spondylitis (AS), Systemic Lupus Erythematosus (SLE or "Lupus"), Psoriatic Arthritis (PsA), Osteoarthritis, Gout, and the like), Herniation, Achondroplasia, Benign or non-cancerous chondroma, Malignant or cancerous chondrosarcoma, Chondriodystrophies, Chondromalacia patella, Costochondritis, Halus rigidus, Hip labral tear, Osteochondritis dssecans, Osteochondrodysplasias, Torn meniscus, Pectus carinatum, Pectus excavatum, Chondropathy, Chondromalacia, Polychondritis, Relapsing Polychondritis, Slipped epiphysis, Osteochondritis Dissecans, Chondrodysplasia, Costochondritis, Perichondritis, Osteochondroma, Knee osteoarthritis, Finger osteoarthritis, Wrist osteoarthritis, Hip osteoarthritis, Spine osteoarthritis, Chondromalacia, Osteoarthritis Susceptibility, Ankle Osteoarthritis, Spondylosis, Secondary chondrosarcoma, Small and unstable nodules as seen in osteoarthritis, Osteochondroses, Primary chondrosarcoma, Cartilage disorders, scleroderma, collagen disorders, Chondrodysplasia, Tietze syndrome, Dermochondrocomeal dystrophy of Francois, Epiphyseal dysplasia multiple 1, Epiphyseal dysplasia multiple 2, Epiphyseal dysplasia multiple 3, Epiphyseal dysplasia multiple 4, Epiphyseal dysplasia multiple 5, Ossified Ear cartilages with Mental deficiency, Muscle Wasting and Bony Changes, Periosteal chondrosarcoma, Carpotarsal osteochondromatosis, Achondroplasia, Genochondromatosis II, Genochondromatosis, Chondrodysplasia—disorder of sex development, Chondroma, Chordoma, Atelosteogenesis, type 1, Atelosteogenesis Type III, Atelosteogenesis, type 2, Pyknoachondrogenesis, Osteoarthropathy of fingers familial, Dyschondrosteosis—nephritis, Coloboma of Alar-nasal cartilages with telecanthus, Alar cartilages hypoplasia—coloboma—telecanthus, Pierre Robin syndrome—fetal chondrodysplasia, Dysspondyloenchondromatosis, Achondroplasia regional—dysplasia abdominal muscle, Osteochondritis Dissecans, Familial Articular Chondrocalcinosis, Tracheobronchomalacia, Chondritis, Dyschondrosteosis, Jequier-Kozlowski-skeletal dysplasia, Chondrodystrophy, Cranio osteoarthropathy, Tietze's syndrome, Hip dysplasia—ecchondromata, Bessel-Hagen disease, Chondromatosis (benign), Enchondromatosis (benign), Chondrocalcinosis due to apatite crystal deposition, Meyenburg-Altherr-Uehlinger syndrome, Enchondromatosis-dwarfism-deafness, premature growth plate closure (e.g., due to dwarfism, injury, therapy such as retinoid therapy for adolescent acne, or ACL repair), Astley-Kendall syndrome, Synovial osteochondromatosis, Severe achondroplasia with developmental delay and acanthosis *nigricans*, Chondrocalcinosis, Stanescu syndrome, Familial osteochondritis dissecans, Achondrogenesis type 1A, Achondrogenesis type 2, Achondrogenesis, Langer-Saldino Type, Achondrogenesis type 1B, Achondrogenesis type 1A and 1B, Type II Achondrogenesis-Hypochondrogenesis, Achondrogenesis, Achondrogenesis type 3, Achondrogenesis type 4, Chondrocalcinosis 1, Chondrocalcinosis 2, Chondrocalcinosis familial articular, Diastrophic dysplasia, Fibrochondrogenesis, Hypochondroplasia, Keutel syndrome, Maffucci Syndrome, Osteoarthritis Susceptibility 6, Osteoarthritis Susceptibility 5, Osteoarthritis Susceptibility 4, Osteoarthritis Susceptibility 3, Osteoarthritis Susceptibility 2, Osteoarthritis Susceptibility 1, Pseudoachondroplasia, Cauliflower ear, Costochondritis, Growth plate fractures, Pectus excavatum, septic arthritis, gout, pseudogout (calcium pyrophosphate deposition disease or CPPD), gouty arthritis, bacterial, viral, or fungal infections in or near the joint, bursitis, tendinitis, arthropathies, or a joint disease condition. Examples of bone diseases or conditions that can be treated with a peptide of the disclosure include osteopenia, post-menopausal bone loss, bone maintenance, bone fracture, arthroplasty recovery, osteoporosis, bone loss due to metastatic cancer, fractures due to bone loss (e.g., hip fractures in patients with osteoporosis), pathological fracture, or atypical fracture.

In some embodiments, a peptide or peptide conjugate of this disclosure can be administered to a subject in order to target, an arthritic joint. In other embodiments, a peptide or peptide conjugate of this disclosure can be administered to a subject in order to treat an arthritic joint.

In some embodiments, the present disclosure provides a method for treating a cancer, the method comprising administering to a subject in need thereof an effective amount of a peptide of the present disclosure.

In some embodiments, the present disclosure provides a method for treating a cancer, the method comprising administering to a patient in need thereof an effective amount of a pharmaceutical composition comprising a peptide of the present disclosure and a pharmaceutically acceptable carrier.

In some embodiments, the peptides of the present disclosure can be used to treat chondrosarcoma. Chondrosarcoma is a cancer of cartilage producing cells and is often found in bones and joints. It falls within the family of bone and soft-tissue sarcomas. In certain embodiments, administration of a peptide or peptide conjugate of the present disclosure can be used to image and diagnose or target and treat a subject with chondrosarcoma. The administration of a peptide or peptide conjugate of the present disclosure can be used in combination with ablative radiotherapy or proton therapy to treat chondrosarcoma. The subject can be a human or an animal.

In some embodiments, a peptide or peptide conjugate of this disclosure can be used to treat Chordoma. In certain embodiments, administration of a peptide or peptide conjugate of the present disclosure can be used to image and diagnose or target and treat a subject with chordoma. The administration of a peptide or peptide conjugate of the present disclosure can be used in combination with a tyrosine kinase inhibitor, such as imatinib mesylate, and ablative radiotherapy or proton therapy to treat chordoma. The administration of a peptide or peptide conjugate of the present disclosure can be used in combination with an antivascular agent such as bevacizumab and an epidermal growth factor receptor inhibitor such as erlotinib to treat chordoma. The subject can be a human or an animal.

In some embodiments, the present disclosure provides a method for inhibiting invasive activity of cells, the method comprising administering an effective amount of a peptide of the present disclosure to a subject.

In some embodiments, the peptides of the present disclosure are conjugated to one or more therapeutic agents. In further embodiments, the therapeutic agent is a chemotherapeutic, anti-cancer drug, or anti-cancer agent selected from, but are not limited to: anti-inflammatories, such as for example a glucocorticoid, a corticosteroid, a protease inhibitor, such as for example collagenase inhibitor or a matrix metalloprotease inhibitor (i.e., MMP-13 inhibitor), an amino sugar, vitamin (e.g., Vitamin D), and antibiotics, antiviral, or antifungal, a statin, an immune modulator, radioisotopes, toxins, enzymes, sensitizing drugs, nucleic acids, including interfering RNAs, antibodies, anti-angiogenic agents, cisplatin, anti-metabolites, mitotic inhibitors, growth factor inhibitors, paclitaxel, temozolomide, topotecan, fluorouracil, vincristine, vinblastine, procarbazine, decarbazine, altretamine, methotrexate, mercaptopurine, thioguanine, fludarabine phosphate, cladribine, pentostatin, cytarabine, azacitidine, etoposide, teniposide, irinotecan, docetaxel, doxorubicin, daunorubicin, dactinomycin, idarubicin, plicamycin, mitomycin, bleomycin, tamoxifen, flutamide, leuprolide, goserelin, aminogluthimide, anastrozole, amsacrine, asparaginase, mitoxantrone, mitotane and amifostine, and their equivalents, as well as photo-ablation. Some of these active agents induce programmed cell death such as apoptosis in target cells and thereby improve symptoms or ameliorate disease. Apoptosis can be induced by many active agents, including, for example, chemotherapeutics, anti-inflammatories, corticosteroids, NSAIDS, tumor necrosis factor alpha (TNF-α) modulators, tumor necrosis factor receptor (TNFR) family modulators. In some embodiments, peptides of this disclosure can be used to target active agents to pathways of cell death or cell killing, such as caspases, apoptosis activators and inhibitors, XBP-1, Bcl-2, Bcl-X1, Bcl-w, and other disclosed herein. In other embodiments, the therapeutic agent is any nonsteroidal anti-inflammatory drug (NSAID). The NSAID can be any heterocyclic acetic acid derivatives such as ketorolac, indomethacin, etodolac, or tolemetin, any propionic acid derivatives such as naproxen, any enolic acid derivatives, any anthranilic acid derivatives, any selective COX-2 inhibitors such as celecoxib, any sulfonanilides, any salicylates, aceclofenac, nabumetone, sulindac, diclofenac, or ibuprofen. In other embodiments, the therapeutic agent is any steroid, such as dexamethasone, budesonide, beclomethasone monopropionate, desciclesonide, triamcinolone, cortisone, prednisone, prednisolone, triamcinolone hexacetonide, or methylprednisolone. In other embodiments, the therapeutic agent is a pain reliever, such as acetaminophen, opioids, local anesthetics, antidepressants, glutamate receptor antagonists, adenosine, or neuropeptides. In some embodiments, a treatment consists of administering a combination of any of the above therapeutic agents and a peptide conjugate, such as a treatment in which both a dexamethasone-peptide conjugate and an NSAID are administered to a patient. Peptides of the current disclosure that target the cartilage can be used to treat the diseases conditions as described herein, for example, any diseases or conditions including tears, injuries (i.e., sports injuries), genetic factors, degradation, thinning, inflammation, cancer or any other disease or condition of the cartilage or to target therapeutically-active substances to treat these diseases amongst others. In other cases, a peptide of the disclosure can be used to treat traumatic rupture, detachment, chostochondritis, spinal disc hemiation, relapsing and non-relapsing polychondritis, injury to the articular cartilage, osteoarthritis, arthritis or achondroplasia. In some cases, the peptide or peptide-active agent can be used to target cancer in the cartilage, for example benign chondroma or malignant chondrosarcoma, by contacting the cartilage by diffusion into chondrocytes and then having antitumor function, targeted toxicity, inhibiting metastases, etc. As well, such peptide or peptide-active agent can be used to label, detect, or image such cartilage lesions, including tumors and metastases amongst other lesions, which may be removed through various surgical techniques or by targeting with peptide-active agents that induce programmed cell death or kill cells.

Venom or toxin derived peptide(s), peptides, modified peptides, labeled peptides, peptide-active agent conjugates and pharmaceutical compositions described herein can be administered for prophylactic and/or therapeutic treatments. In therapeutic applications, the composition can be administered to a subject already suffering from a disease or condition, in an amount sufficient to cure or at least partially arrest the symptoms of the disease or condition, or to cure, heal, improve, or ameliorate the condition. Such peptides described herein can also be administered to prevent (either in whole or in part), lessen a likelihood of developing, contracting, or worsening a condition. Amounts effective for this use can vary based on the severity and course of the disease or condition, previous therapy, the subject's health status, weight, response to the drugs, and the judgment of the treating physician. Venom or toxin derived peptide(s), peptides, modified peptides, labeled peptides, peptide-active agent conjugates and pharmaceutical compositions described herein can allow for targeted homing of the peptide and local delivery of any conjugate. For example, a peptide conjugated to a steroid allows for local delivery of the steroid, which is significantly more effective and less toxic than traditional systemic steroids. A peptide conjugated to an NSAID is another example. In this case, the peptide conjugated to an NSAID allows for local delivery of the NSAID, which allows for administration of a lower NSAID dose and is subsequently less toxic. By delivering an active agent to the joint, pain relief can be more rapid, may be more long lasting, and can be obtained with a lower systemic dose and off-site undesired effects than with systemic dosing without targeting.

Peptides of the current disclosure that target the cartilage can be used to treat or manage pain associated with a cartilage injury or disorder, or any other cartilage or joint condition as described herein. The peptides can be used either directly or as carriers of active drugs, peptides, or molecules. For example, since ion channels can be associated with pain and can be activated in disease states such as arthritis, peptides that interact with ion channels can be used directly to reduce pain. In another embodiment, the peptide is conjugated to an active agent with anti-inflammatory activity, in which the peptide acts as a carrier for the local delivery of the active agent to reduce pain.

In some embodiments, the peptides described herein provide a method of treating a cartilage condition of a subject, the method comprising administering to the subject a therapeutically-effective amount of a peptide comprising the sequence SEQ ID NO: 485 or fragment thereof. In some embodiments, the peptides described herein provide a method of treating a cartilage condition of a subject, the method comprising administering to the subject a peptide of any one of SEQ ID NO: 486-SEQ ID NO: 1048 or fragment thereof.

Treatment of Kidney Disorders

In some embodiments, peptides of this disclosure that home, target, are directed to, migrate to, are retained by, accumulate in, or bind to specific regions, tissues, structures or cells of the kidneys can be used to treat a kidney disorder. In other embodiments, peptides are used in peptide conjugates of the present disclosure to deliver an active agent for treatment of a kidney disorder.

In some embodiments, the peptides and peptide-conjugates of the present disclosure are used to treat a condition of the kidney, or a region, tissue, structure, or cell thereof.

In certain embodiments, the condition is associated with kidney, or a function of a subject's kidneys. The present disclosure encompasses various acute and chronic renal diseases, including glomerular, tubule-interstitial, and microvascular diseases. Examples of conditions applicable to the present disclosure include but are not limited to: hypertensive kidney damage, acute kidney diseases and disorders (AKD), acute kidney injury (AKI) due to ischemia-reperfusion injury, drug treatment such as chemotherapy, cardiovascular surgery, surgery, medical interventions or treatment, radiocontrast nephropathy, or induced by cisplatin or carboplatin, which can be treated prophylactically, established AKI including ischemic renal injury, endotoxemia-induced AKI, endotoxemia/sepsis syndrome, or established nephrotoxic AKI (e.g., rhabdomyolysis, radiocontrast nephropathy, cisplatin/carboplatin AKI, aminoglycoside nephrotoxicity), end stage renal disease, acute and rapidly progressive glomerulonephritis, acute presentations of nephrotic syndrome, acute pyelonephritis, acute renal failure, chronic glomerulonephritis, chronic heart failure, chronic interstitial nephritis, graft versus host disease after renal transplant, chronic kidney disease (CKD) such as diabetic nephropathy, hypertensive nephrosclerosis, idiopathic chronic glomerulonephritis (e.g., focal glomerular sclerosis, membranous nephropathy, membranoproliferative glomerulonephritis, minimal change disease transition to chronic disease, anti-GBM disease, rapidly progressive cresentic glomerulonephritis, IgA nephropathy), secondary chronic glomerulonephritis (e.g., systemic lupus, polyarteritis nodosa, scleroderma, amyloidosis, endocarditis), hereditary nephropathy (e.g., polycystic kidney disease, Alport's syndrome), interstitial nephritis induced by drugs (e.g., Chinese herbs, NSAIDs), multiple myeloma or sarcoid, or renal transplantation such as donor kidney prophylaxis (treatment of donor kidney prior to transplantation), treatment post transplantation to treat delayed graft function, acute rejection, or chronic rejection, chronic liver disease, chronic pyelonephritis, diabetes, diabetic kidney disease, fibrosis, focal segmental glomerulosclerosis, Goodpasture's disease, hypertensive nephrosclerosis, IgG4-related renal disease, interstitial inflammation, lupus nephritis, nephritic syndrome, partial obstruction of the urinary tract, polycystic kidney disease, progressive renal disease, renal cell carcinoma, renal fibrosis, and vasculitis. For example, in certain embodiments, the peptides and peptide-conjugates of the present disclosure are used to reduce acute kidney injury in order to prevent it from progressing to chronic kidney disease.

Alternatively or in combination, in some embodiments, the peptide and peptide-conjugates of the present disclosure are used to elicit a protective response such as ischemic preconditioning and/or acquired cytoresistance in a kidney of the subject. In some embodiments, ischemic preconditioning and/or acquired cytoresistance is induced by administering an agent (e.g., a peptide or peptide-conjugate of the present disclosure) that upregulates the expression of protective stress proteins, such as antioxidants, anti-inflammatory proteins, or protease inhibitors. In certain embodiments, the induced response protects the kidney by preserving kidney function in whole or in part and/or by reducing injury to renal tissues and cells, e.g., relative to the situation where no protective response is induced. The peptides and peptide-conjugates of the present disclosure can provide certain benefits compared to other agents for inducing ischemic preconditioning and/or acquired cytoresistance, such as a well-defined chemical structure and avoidance of low pH precipitation.

In some embodiments, the protective response is induced in order to protect the kidney or tissues or cells thereof from an injury or insult that is predicted to occur (e.g., associated with a planned event such as a medical procedure, is likely to occur due to a condition in the subject) or has already occurred. In certain embodiments, the induced response prevents or reduces the extent of damage to the kidney or tissues or cells thereof caused by the injury or insult. For instance, in certain embodiments, the peptides and peptide-conjugates induce acquired cytoresistance by activating protective pathways and/or upregulating expression of protective stress proteins. Optionally, the peptides and peptide-conjugates are capable of inducing such protective responses while causing minimal or no injury to the kidney.

In various embodiments, the injury or insult is associated with one or more of: surgery, radiocontrast imaging, cardiopulmonary bypass, balloon angioplasty, induced cardiac or cerebral ischemic-reperfusion injury, organ transplantation, sepsis, shock, low blood pressure, high blood pressure, kidney hypoperfusion, chemotherapy, drug administration, nephrotoxic drug administration, blunt force trauma, puncture, poison, or smoking. For instance, in certain embodiments, the injury or insult is associated with a medical procedure that has been or will be performed on the subject, such as one or more of: surgery, radiocontrast imaging, cardiopulmonary bypass, balloon angioplasty, induced cardiac or cerebral ischemic-reperfusion injury, organ transplantation, chemotherapy, drug administration, or nephrotoxic drug administration.

In some embodiments, the peptide itself exhibits a renal therapeutic effect. For example, in certain embodiments, the cystine-dense peptide interacts with a renal ion channel, inhibits a protease, has antimicrobial activity, has anticancer activity, has anti-inflammatory activity, induces ischemic preconditioning or acquired cytoresistance, or produces a protective or therapeutic effect on a kidney of the subject, or a combination thereof. Optionally, the renal therapeutic effect exhibited by the peptide is a renal protective effect or renal prophylactic effect (e.g., ischemic preconditioning or acquired cytoresistance) that protects the kidney or a tissue or cell thereof from an upcoming injury or insult.

For example, in certain embodiments, a peptide of the present disclosure activates protective pathways and/or upregulates expression of protective stress proteins in the kidney or tissues or cells thereof. As another example, in certain embodiments, a peptide of the present disclosure accesses and suppresses intracellular injury pathways. In yet another example, in certain embodiments, a peptide of the present disclosure inhibits interstitial inflammation and prevents renal fibrosis. As a further example, in certain embodiments, a peptide of the present disclosure is administered prior to or currently with the administration of a nephrotoxic agent (e.g., aminoglycoside antibiotics such as gentamicin and minocycline, chemotherapeutics such as cisplatin, immunoglobulins or fragments thereof, mannitol, NSAIDs such as ketorolac or ibuprofen, cyclosporin, cyclophosphamide, radiocontrast dyes) in order to minimize its damaging effects, e.g., by blocking megalin-cubulin binding sites so that the nephrotoxic agent passes through the kidneys.

In some embodiments, the present disclosure provides that any peptide of the disclosure including SEQ ID NO: 508-SEQ ID NO: 758 or SEQ ID NO: 798-SEQ ID NO: 1048 can as a peptide conjugate with an active agent for treatment of a kidney disorder. For example, a peptide of SEQ ID NO: 511, SEQ ID NO: 592, or SEQ ID NO: 683 can be conjugated to an active agent and administered to a subject in need thereof to treat a kidney disorder.

In some embodiments, homing of a peptide of this disclosure to cartilage or the kidneys can be assessed in an animal model such as those described in Alves et al. (*Clin Rev Allergy Immunol.* 2016 August; 51(1):27-47. doi: 10. 1007/s12016-015-8522-7), Kuyinu et al. (*J Orthop Surg Res.* 2016 Feb. 2; 11:19. doi: 10. 1186/s13018-016-0346-5), Li et al. (*Exp Biol Med* (Maywood). 2015 August; 240(8): 1029-38. doi: 10. 1177/1535370215594583), and Mullins et al. (*Dis Model Mech.* 2016 Dec. 1; 9(12):1419-1433), all of which are incorporated herein by reference.

Multiple peptides described herein can be administered in any order or simultaneously. In some cases, multiple functional fragments of peptides derived from toxins or venom can be administered in any order or simultaneously. If simultaneously, the multiple peptides described herein can be provided in a single, unified form, such as an intravenous injection, or in multiple forms, such as subsequent intravenous dosages.

Peptides can be packaged as a kit. In some embodiments, a kit includes written instructions on the use or administration of the peptides.

Conjugate Compounds

The present disclosure provides compounds that selectively bind to cancerous cells and tissues. In various aspects, the compounds of the present disclosure comprise a peptide portion and a detectable agent conjugated together.

In various aspects of the present disclosure, the peptide portions of the compounds described herein have certain features in common with the native chlorotoxin (CTX) peptide. The native chlorotoxin peptide was originally isolated from the scorpion *Leiurus quinquestriatus*. Chlorotoxin is a 36 amino acid peptide that selectively binds to cancerous cells. The peptide portions of the present compounds have advantageously retained at least some of the cancer-cell binding activity of chlorotoxin. The cancer-cell binding activity of chlorotoxin provides certain advantages for the detection and treatment of cancer because it facilitates the selective localization of detectable agents and therapeutic agents to the cancer cells for the detection and treatment of cancer.

Table 1 below sets forth certain polypeptide sequences for use with the present disclosure. Citrulline is designated as "Cit" in the sequences.

TABLE 1

Exemplary peptide sequences suitable for use in the compounds of the present disclosure.

| SEQ ID NO. | Polypeptide Sequence |
|---|---|
| 1 | MCMPCFTTDHQMARKCDDCCGGKGRGKCYGPQCLCR |
| 2 | MCMPCFTTDHQMARACDDCCGGKGRGKCYGPQCLCR |

TABLE 1-continued

Exemplary peptide sequences suitable for use in the compounds of the present disclosure.

| SEQ ID NO. | Polypeptide Sequence |
|---|---|
| 3 | MCMPCFTTDHQMARRCDDCCGGKGRGKCYGPQCLCR |
| 4 | MCMPCFTTDHQMARKCDDCCGGAGRGKCYGPQCLCR |
| 5 | MCMPCFTTDHQMARACDDCCGGAGRGKCYGPQCLCR |
| 6 | MCMPCFTTDHQMARRCDDCCGGAGRGKCYGPQCLCR |
| 7 | MCMPCFTTDHQMARKCDDCCGGRGRGKCYGPQCLCR |
| 8 | MCMPCFTTDHQMARACDDCCGGRGRGKCYGPQCLCR |
| 9 | MCMPCFTTDHQMARRCDDCCGGRGRGKCYGPQCLCR |
| 10 | MCMPCFTTDHQMARKCDDCCGGKGRGACYGPQCLCR |
| 11 | MCMPCFTTDHQMARACDDCCGGKGRGACYGPQCLCR |
| 12 | MCMPCFTTDHQMARRCDDCCGGKGRGACYGPQCLCR |
| 13 | MCMPCFTTDHQMARKCDDCCGGAGRGACYGPQCLCR |
| 14 | MCMPCFTTDHQMARACDDCCGGAGRGACYGPQCLCR |
| 15 | MCMPCFTTDHQMARRCDDCCGGAGRGACYGPQCLCR |
| 16 | MCMPCFTTDHQMARKCDDCCGGRGRGACYGPQCLCR |
| 17 | MCMPCFTTDHQMARACDDCCGGRGRGACYGPQCLCR |
| 18 | MCMPCFTTDHQMARRCDDCCGGRGRGACYGPQCLCR |
| 19 | MCMPCFTTDHQMARKCDDCCGGKGRGRCYGPQCLCR |
| 20 | MCMPCFTTDHQMARACDDCCGGKGRGRCYGPQCLCR |
| 21 | MCMPCFTTDHQMARRCDDCCGGKGRGRCYGPQCLCR |
| 22 | MCMPCFTTDHQMARKCDDCCGGAGRGRCYGPQCLCR |
| 23 | MCMPCFTTDHQMARACDDCCGGAGRGRCYGPQCLCR |
| 24 | MCMPCFTTDHQMARRCDDCCGGAGRGRCYGPQCLCR |
| 25 | MCMPCFTTDHQMARKCDDCCGGRGRGRCYGPQCLCR |
| 26 | MCMPCFTTDHQMARACDDCCGGRGRGRCYGPQCLCR |
| 27 | MCMPCFTTDHQMARRCDDCCGGRGRGRCYGPQCLCR |
| 28 | MCMPCFTTDHQMARRCDDCCGGRGRGRCYGPQCLCR |
| 29 | KCMPCFTTDHQMARRCDDCCGGRGRGRCYGPQCLCR |
| 30 | ACAPCFTTDHQAARRCDDCCGGRGRGRCYGPQCLCR |
| 31 | KCAPCFTTDHQAARRCDDCCGGRGRGRCYGPQCLCR |
| 32 | MCMPCFTTDHQMAR(Cit)CDDCCGG(Cit)GRGKCYGPQCLCR |
| 33 | MCMPCFTTDHQMAR(Cit)CDDCCGG(Cit)GRG(Cit)CYGPQCLCR |
| 34 | KCMPCFTTDHQMAR(Cit)CDDCCGG(Cit)GRG(Cit)CYGPQCLCR |
| 35 | ACAPCFTTDHQAAR(Cit)CDDCCGG(Cit)GRGKCYGPQCLCR |
| 36 | ACAPCFTTDHQAAR(Cit)CDDCCGG(Cit)GRG(Cit)CYGPQCLCR |
| 37 | KCAPCFTTDHQAAR(Cit)CDDCCGG(Cit)GRG(Cit)CYGPQCLCR |
| 38 | MCMPCFTTDHQMARKCDDCCGGKGRGKCYGPQCLCRGAGAAGG |
| 39 | MCMPCFTTDHQMARACDDCCGGKGRGKCYGPQCLCRGAGAAGG |

TABLE 1-continued

Exemplary peptide sequences suitable for use in the compounds of the present disclosure.

| SEQ ID NO. | Polypeptide Sequence |
|---|---|
| 40 | MCMPCFTTDHQMARRCDDCCGGKGRGKCYGPQCLCRGAGAAGG |
| 41 | MCMPCFTTDHQMARKCDDCCGGAGRGKCYGPQCLCRGAGAAGG |
| 42 | MCMPCFTTDHQMARACDDCCGGAGRGKCYGPQCLCRGAGAAGG |
| 43 | MCMPCFTTDHQMARRCDDCCGGAGRGKCYGPQCLCRGAGAAGG |
| 44 | MCMPCFTTDHQMARKCDDCCGGRGRGKCYGPQCLCRGAGAAGG |
| 45 | MCMPCFTTDHQMARACDDCCGGRGRGKCYGPQCLCRGAGAAGG |
| 46 | MCMPCFTTDHQMARRCDDCCGGRGRGKCYGPQCLCRGAGAAGG |
| 47 | MCMPCFTTDHQMARKCDDCCGGKGRGACYGPQCLCRGAGAAGG |
| 48 | MCMPCFTTDHQMARACDDCCGGKGRGACYGPQCLCRGAGAAGG |
| 49 | MCMPCFTTDHQMARRCDDCCGGKGRGACYGPQCLCRGAGAAGG |
| 50 | MCMPCFTTDHQMARKCDDCCGGAGRGACYGPQCLCRGAGAAGG |
| 51 | MCMPCFTTDHQMARACDDCCGGAGRGACYGPQCLCRGAGAAGG |
| 52 | MCMPCFTTDHQMARRCDDCCGGAGRGACYGPQCLCRGAGAAGG |
| 53 | MCMPCFTTDHQMARKCDDCCGGRGRGACYGPQCLCRGAGAAGG |
| 54 | MCMPCFTTDHQMARACDDCCGGRGRGACYGPQCLCRGAGAAGG |
| 55 | MCMPCFTTDHQMARRCDDCCGGRGRGACYGPQCLCRGAGAAGG |
| 56 | MCMPCFTTDHQMARKCDDCCGGKGRGRCYGPQCLCRGAGAAGG |
| 57 | MCMPCFTTDHQMARACDDCCGGKGRGRCYGPQCLCRGAGAAGG |
| 58 | MCMPCFTTDHQMARRCDDCCGGKGRGRCYGPQCLCRGAGAAGG |
| 59 | MCMPCFTTDHQMARKCDDCCGGAGRGRCYGPQCLCRGAGAAGG |
| 60 | MCMPCFTTDHQMARACDDCCGGAGRGRCYGPQCLCRGAGAAGG |
| 61 | MCMPCFTTDHQMARRCDDCCGGAGRGRCYGPQCLCRGAGAAGG |
| 62 | MCMPCFTTDHQMARKCDDCCGGRGRGRCYGPQCLCRGAGAAGG |
| 63 | MCMPCFTTDHQMARACDDCCGGRGRGRCYGPQCLCRGAGAAGG |
| 64 | MCMPCFTTDHQMARRCDDCCGGRGRGRCYGPQCLCRGAGAAGG |
| 65 | MCMPCFTTDHQMARRCDDCCGGRGRGRCYGPQCLCRGAGAAGG |
| 66 | KCMPCFTTDHQMARRCDDCCGGRGRGRCYGPQCLCRGAGAAGG |
| 67 | ACAPCFTTDHQAARRCDDCCGGRGRGRCYGPQCLCRGAGAAGG |
| 68 | KCAPCFTTDHQAARRCDDCCGGRGRGRCYGPQCLCRGAGAAGG |
| 69 | MCMPCFTTDHQMAR(Cit)CDDCCGG(Cit)GRGKCYGPQCLCRGAGAAGG |
| 70 | MCMPCFTTDHQMAR(Cit)CDDCCGG(Cit)GRG(Cit)CYGPQCLCRGAGAAGG |
| 71 | KCMPCFTTDHQMAR(Cit)CDDCCGG(Cit)GRG(Cit)CYGPQCLCRGAGAAGG |
| 72 | ACAPCFTTDHQAAR(Cit)CDDCCGG(Cit)GRGKCYGPQCLCRGAGAAGG |
| 73 | ACAPCFTTDHQAAR(Cit)CDDCCGG(Cit)GRG(Cit)CYGPQCLCRGAGAAGG |
| 74 | KCAPCFTTDHQAAR(Cit)CDDCCGG(Cit)GRG(Cit)CYGPQCLCRGAGAAGG |
| 75 | MCMPCFTTDHQMVRKCDDCCGGKGRGKCYGPQCLCR |
| 76 | MCMPCFTTDHQMVRVCDDCCGGKGRGKCYGPQCLCR |

TABLE 1-continued

Exemplary peptide sequences suitable for use in the compounds of the present disclosure.

| SEQ ID NO. | Polypeptide Sequence |
|---|---|
| 77 | MCMPCFTTDHQMVRRCDDCCGGKGRGKCYGPQCLCR |
| 78 | MCMPCFTTDHQMVRKCDDCCGGVGRGKCYGPQCLCR |
| 79 | MCMPCFTTDHQMVRVCDDCCGGVGRGKCYGPQCLCR |
| 80 | MCMPCFTTDHQMVRRCDDCCGGVGRGKCYGPQCLCR |
| 81 | MCMPCFTTDHQMVRKCDDCCGGRGRGKCYGPQCLCR |
| 82 | MCMPCFTTDHQMVRVCDDCCGGRGRGKCYGPQCLCR |
| 83 | MCMPCFTTDHQMVRRCDDCCGGRGRGKCYGPQCLCR |
| 84 | MCMPCFTTDHQMVRKCDDCCGGKGRGVCYGPQCLCR |
| 85 | MCMPCFTTDHQMVRVCDDCCGGKGRGVCYGPQCLCR |
| 86 | MCMPCFTTDHQMVRRCDDCCGGKGRGVCYGPQCLCR |
| 87 | MCMPCFTTDHQMVRKCDDCCGGVGRGVCYGPQCLCR |
| 88 | MCMPCFTTDHQMVRVCDDCCGGVGRGVCYGPQCLCR |
| 89 | MCMPCFTTDHQMVRRCDDCCGGVGRGVCYGPQCLCR |
| 90 | MCMPCFTTDHQMVRKCDDCCGGRGRGVCYGPQCLCR |
| 91 | MCMPCFTTDHQMVRVCDDCCGGRGRGVCYGPQCLCR |
| 92 | MCMPCFTTDHQMVRRCDDCCGGRGRGVCYGPQCLCR |
| 93 | MCMPCFTTDHQMVRKCDDCCGGKGRGRCYGPQCLCR |
| 94 | MCMPCFTTDHQMVRVCDDCCGGKGRGRCYGPQCLCR |
| 95 | MCMPCFTTDHQMVRRCDDCCGGKGRGRCYGPQCLCR |
| 96 | MCMPCFTTDHQMVRKCDDCCGGVGRGRCYGPQCLCR |
| 97 | MCMPCFTTDHQMVRVCDDCCGGVGRGRCYGPQCLCR |
| 98 | MCMPCFTTDHQMVRRCDDCCGGVGRGRCYGPQCLCR |
| 99 | MCMPCFTTDHQMVRKCDDCCGGRGRGRCYGPQCLCR |
| 100 | MCMPCFTTDHQMVRVCDDCCGGRGRGRCYGPQCLCR |
| 101 | MCMPCFTTDHQMVRRCDDCCGGRGRGRCYGPQCLCR |
| 102 | MCMPCFTTDHQMVRRCDDCCGGRGRGRCYGPQCLCR |
| 103 | KCMPCFTTDHQMVRRCDDCCGGRGRGRCYGPQCLCR |
| 104 | VCVPCFTTDHQVVRRCDDCCGGRGRGRCYGPQCLCR |
| 105 | KCVPCFTTDHQVVRRCDDCCGGRGRGRCYGPQCLCR |
| 106 | MCMPCFTTDHQMVR(Cit)CDDCCGG(Cit)GRGKCYGPQCLCR |
| 107 | MCMPCFTTDHQMVR(Cit)CDDCCGG(Cit)GRG(Cit)CYGPQCLCR |
| 108 | KCMPCFTTDHQMVR(Cit)CDDCCGG(Cit)GRG(Cit)CYGPQCLCR |
| 109 | VCVPCFTTDHQVVR(Cit)CDDCCGG(Cit)GRGKCYGPQCLCR |
| 110 | VCVPCFTTDHQVVR(Cit)CDDCCGG(Cit)GRG(Cit)CYGPQCLCR |
| 111 | KCVPCFTTDHQVVR(Cit)CDDCCGG(Cit)GRG(Cit)CYGPQCLCR |
| 112 | MCMPCFTTDHQMVRKCDDCCGGKGRGKCYGPQCLCRGAGAAGG |
| 113 | MCMPCFTTDHQMVRVCDDCCGGKGRGKCYGPQCLCRGAGAAGG |

TABLE 1-continued

Exemplary peptide sequences suitable for use in the compounds of the present disclosure.

| SEQ ID NO. | Polypeptide Sequence |
|---|---|
| 114 | MCMPCFTTDHQMVRRCDDCCGGKGRGKCYGPQCLCRGAGAAGG |
| 115 | MCMPCFTTDHQMVRKCDDCCGGVGRGKCYGPQCLCRGAGAAGG |
| 116 | MCMPCFTTDHQMVRVCDDCCGGVGRGKCYGPQCLCRGAGAAGG |
| 117 | MCMPCFTTDHQMVRRCDDCCGGVGRGKCYGPQCLCRGAGAAGG |
| 118 | MCMPCFTTDHQMVRKCDDCCGGRGRGKCYGPQCLCRGAGAAGG |
| 119 | MCMPCFTTDHQMVRVCDDCCGGRGRGKCYGPQCLCRGAGAAGG |
| 120 | MCMPCFTTDHQMVRRCDDCCGGRGRGKCYGPQCLCRGAGAAGG |
| 121 | MCMPCFTTDHQMVRKCDDCCGGKGRGVCYGPQCLCRGAGAAGG |
| 122 | MCMPCFTTDHQMVRVCDDCCGGKGRGVCYGPQCLCRGAGAAGG |
| 123 | MCMPCFTTDHQMVRRCDDCCGGKGRGVCYGPQCLCRGAGAAGG |
| 124 | MCMPCFTTDHQMVRKCDDCCGGVGRGVCYGPQCLCRGAGAAGG |
| 125 | MCMPCFTTDHQMVRVCDDCCGGVGRGVCYGPQCLCRGAGAAGG |
| 126 | MCMPCFTTDHQMVRRCDDCCGGVGRGVCYGPQCLCRGAGAAGG |
| 127 | MCMPCFTTDHQMVRKCDDCCGGRGRGVCYGPQCLCRGAGAAGG |
| 128 | MCMPCFTTDHQMVRVCDDCCGGRGRGVCYGPQCLCRGAGAAGG |
| 129 | MCMPCFTTDHQMVRRCDDCCGGRGRGVCYGPQCLCRGAGAAGG |
| 130 | MCMPCFTTDHQMVRKCDDCCGGKGRGRCYGPQCLCRGAGAAGG |
| 131 | MCMPCFTTDHQMVRVCDDCCGGKGRGRCYGPQCLCRGAGAAGG |
| 132 | MCMPCFTTDHQMVRRCDDCCGGKGRGRCYGPQCLCRGAGAAGG |
| 133 | MCMPCFTTDHQMVRKCDDCCGGVGRGRCYGPQCLCRGAGAAGG |
| 134 | MCMPCFTTDHQMVRVCDDCCGGVGRGRCYGPQCLCRGAGAAGG |
| 135 | MCMPCFTTDHQMVRRCDDCCGGVGRGRCYGPQCLCRGAGAAGG |
| 136 | MCMPCFTTDHQMVRKCDDCCGGRGRGRCYGPQCLCRGAGAAGG |
| 137 | MCMPCFTTDHQMVRVCDDCCGGRGRGRCYGPQCLCRGAGAAGG |
| 138 | MCMPCFTTDHQMVRRCDDCCGGRGRGRCYGPQCLCRGAGAAGG |
| 139 | MCMPCFTTDHQMVRRCDDCCGGRGRGRCYGPQCLCRGAGAAGG |
| 140 | KCMPCFTTDHQMVRRCDDCCGGRGRGRCYGPQCLCRGAGAAGG |
| 141 | VCVPCFTTDHQVVRRCDDCCGGRGRGRCYGPQCLCRGAGAAGG |
| 142 | KCVPCFTTDHQVVRRCDDCCGGRGRGRCYGPQCLCRGAGAAGG |
| 143 | MCMPCFTTDHQMVR(Cit)CDDCCGG(Cit)GRGKCYGPQCLCRGAGAAGG |
| 144 | MCMPCFTTDHQMVR(Cit)CDDCCGG(Cit)GRG(Cit)CYGPQCLCRGAGAAGG |
| 145 | KCMPCFTTDHQMVR(Cit)CDDCCGG(Cit)GRG(Cit)CYGPQCLCRGAGAAGG |
| 146 | VCVPCFTTDHQVVR(Cit)CDDCCGG(Cit)GRGKCYGPQCLCRGAGAAGG |
| 147 | VCVPCFTTDHQVVR(Cit)CDDCCGG(Cit)GRG(Cit)CYGPQCLCRGAGAAGG |
| 148 | KCVPCFTTDHQVVR(Cit)CDDCCGG(Cit)GRG(Cit)CYGPQCLCRGAGAAGG |
| 149 | MCMPCFTTDHQMLRKCDDCCGGKGRGKCYGPQCLCR |
| 150 | MCMPCFTTDHQMLRLCDDCCGGKGRGKCYGPQCLCR |

TABLE 1-continued

Exemplary peptide sequences suitable for use in
the compounds of the present disclosure.

| SEQ ID NO. | Polypeptide Sequence |
|---|---|
| 151 | MCMPCFTTDHQMLRRCDDCCGGKGRGKCYGPQCLCR |
| 152 | MCMPCFTTDHQMLRKCDDCCGGLGRGKCYGPQCLCR |
| 153 | MCMPCFTTDHQMLRLCDDCCGGLGRGKCYGPQCLCR |
| 154 | MCMPCFTTDHQMLRRCDDCCGGLGRGKCYGPQCLCR |
| 155 | MCMPCFTTDHQMLRKCDDCCGGRGRGKCYGPQCLCR |
| 156 | MCMPCFTTDHQMLRLCDDCCGGRGRGKCYGPQCLCR |
| 157 | MCMPCFTTDHQMLRRCDDCCGGRGRGKCYGPQCLCR |
| 158 | MCMPCFTTDHQMLRKCDDCCGGKGRGLCYGPQCLCR |
| 159 | MCMPCFTTDHQMLRLCDDCCGGKGRGLCYGPQCLCR |
| 160 | MCMPCFTTDHQMLRRCDDCCGGKGRGLCYGPQCLCR |
| 161 | MCMPCFTTDHQMLRKCDDCCGGLGRGLCYGPQCLCR |
| 162 | MCMPCFTTDHQMLRLCDDCCGGLGRGLCYGPQCLCR |
| 163 | MCMPCFTTDHQMLRRCDDCCGGLGRGLCYGPQCLCR |
| 164 | MCMPCFTTDHQMLRKCDDCCGGRGRGLCYGPQCLCR |
| 165 | MCMPCFTTDHQMLRLCDDCCGGRGRGLCYGPQCLCR |
| 166 | MCMPCFTTDHQMLRRCDDCCGGRGRGLCYGPQCLCR |
| 167 | MCMPCFTTDHQMLRKCDDCCGGKGRGRCYGPQCLCR |
| 168 | MCMPCFTTDHQMLRLCDDCCGGKGRGRCYGPQCLCR |
| 169 | MCMPCFTTDHQMLRRCDDCCGGKGRGRCYGPQCLCR |
| 170 | MCMPCFTTDHQMLRKCDDCCGGLGRGRCYGPQCLCR |
| 171 | MCMPCFTTDHQMLRLCDDCCGGLGRGRCYGPQCLCR |
| 172 | MCMPCFTTDHQMLRRCDDCCGGLGRGRCYGPQCLCR |
| 173 | MCMPCFTTDHQMLRKCDDCCGGRGRGRCYGPQCLCR |
| 174 | MCMPCFTTDHQMLRLCDDCCGGRGRGRCYGPQCLCR |
| 175 | MCMPCFTTDHQMLRRCDDCCGGRGRGRCYGPQCLCR |
| 176 | MCMPCFTTDHQMLRRCDDCCGGRGRGRCYGPQCLCR |
| 177 | KCMPCFTTDHQMLRRCDDCCGGRGRGRCYGPQCLCR |
| 178 | LCLPCFTTDHQLLRRCDDCCGGRGRGRCYGPQCLCR |
| 179 | KCLPCFTTDHQLLRRCDDCCGGRGRGRCYGPQCLCR |
| 180 | MCMPCFTTDHQMLR(Cit)CDDCCGG(Cit)GRGKCYGPQCLCR |
| 181 | MCMPCFTTDHQMLR(Cit)CDDCCGG(Cit)GRG(Cit)CYGPQCLCR |
| 182 | KCMPCFTTDHQMLR(Cit)CDDCCGG(Cit)GRG(Cit)CYGPQCLCR |
| 183 | LCLPCFTTDHQLLR(Cit)CDDCCGG(Cit)GRGKCYGPQCLCR |
| 184 | LCLPCFTTDHQLLR(Cit)CDDCCGG(Cit)GRG(Cit)CYGPQCLCR |
| 185 | KCLPCFTTDHQLLR(Cit)CDDCCGG(Cit)GRG(Cit)CYGPQCLCR |
| 186 | MCMPCFTTDHQMLRKCDDCCGGKGRGKCYGPQCLCRGAGAAGG |
| 187 | MCMPCFTTDHQMLRLCDDCCGGKGRGKCYGPQCLCRGAGAAGG |

TABLE 1-continued

Exemplary peptide sequences suitable for use in the compounds of the present disclosure.

| SEQ ID NO. | Polypeptide Sequence |
|---|---|
| 188 | MCMPCFTTDHQMLRRCDDCCGGKGRGKCYGPQCLCRGAGAAGG |
| 189 | MCMPCFTTDHQMLRKCDDCCGGLGRGKCYGPQCLCRGAGAAGG |
| 190 | MCMPCFTTDHQMLRLCDDCCGGLGRGKCYGPQCLCRGAGAAGG |
| 191 | MCMPCFTTDHQMLRRCDDCCGGLGRGKCYGPQCLCRGAGAAGG |
| 192 | MCMPCFTTDHQMLRKCDDCCGGRGRGKCYGPQCLCRGAGAAGG |
| 193 | MCMPCFTTDHQMLRLCDDCCGGRGRGKCYGPQCLCRGAGAAGG |
| 194 | MCMPCFTTDHQMLRRCDDCCGGRGRGKCYGPQCLCRGAGAAGG |
| 195 | MCMPCFTTDHQMLRKCDDCCGGKGRGLCYGPQCLCRGAGAAGG |
| 196 | MCMPCFTTDHQMLRLCDDCCGGKGRGLCYGPQCLCRGAGAAGG |
| 197 | MCMPCFTTDHQMLRRCDDCCGGKGRGLCYGPQCLCRGAGAAGG |
| 198 | MCMPCFTTDHQMLRKCDDCCGGLGRGLCYGPQCLCRGAGAAGG |
| 199 | MCMPCFTTDHQMLRLCDDCCGGLGRGLCYGPQCLCRGAGAAGG |
| 200 | MCMPCFTTDHQMLRRCDDCCGGLGRGLCYGPQCLCRGAGAAGG |
| 201 | MCMPCFTTDHQMLRKCDDCCGGRGRGLCYGPQCLCRGAGAAGG |
| 202 | MCMPCFTTDHQMLRLCDDCCGGRGRGLCYGPQCLCRGAGAAGG |
| 203 | MCMPCFTTDHQMLRRCDDCCGGRGRGLCYGPQCLCRGAGAAGG |
| 204 | MCMPCFTTDHQMLRKCDDCCGGKGRGRCYGPQCLCRGAGAAGG |
| 205 | MCMPCFTTDHQMLRLCDDCCGGKGRGRCYGPQCLCRGAGAAGG |
| 206 | MCMPCFTTDHQMLRRCDDCCGGKGRGRCYGPQCLCRGAGAAGG |
| 207 | MCMPCFTTDHQMLRKCDDCCGGLGRGRCYGPQCLCRGAGAAGG |
| 208 | MCMPCFTTDHQMLRLCDDCCGGLGRGRCYGPQCLCRGAGAAGG |
| 209 | MCMPCFTTDHQMLRRCDDCCGGLGRGRCYGPQCLCRGAGAAGG |
| 210 | MCMPCFTTDHQMLRKCDDCCGGRGRGRCYGPQCLCRGAGAAGG |
| 211 | MCMPCFTTDHQMLRLCDDCCGGRGRGRCYGPQCLCRGAGAAGG |
| 212 | MCMPCFTTDHQMLRRCDDCCGGRGRGRCYGPQCLCRGAGAAGG |
| 213 | MCMPCFTTDHQMLRRCDDCCGGRGRGRCYGPQCLCRGAGAAGG |
| 214 | KCMPCFTTDHQMLRRCDDCCGGRGRGRCYGPQCLCRGAGAAGG |
| 215 | LCLPCFTTDHQLLRRCDDCCGGRGRGRCYGPQCLCRGAGAAGG |
| 216 | KCLPCFTTDHQLLRRCDDCCGGRGRGRCYGPQCLCRGAGAAGG |
| 217 | MCMPCFTTDHQMLR(Cit)CDDCCGG(Cit)GRGKCYGPQCLCRGAGAAGG |
| 218 | MCMPCFTTDHQMLR(Cit)CDDCCGG(Cit)GRG(Cit)CYGPQCLCRGAGAAGG |
| 219 | KCMPCFTTDHQMLR(Cit)CDDCCGG(Cit)GRG(Cit)CYGPQCLCRGAGAAGG |
| 220 | LCLPCFTTDHQLLR(Cit)CDDCCGG(Cit)GRGKCYGPQCLCRGAGAAGG |
| 221 | LCLPCFTTDHQLLR(Cit)CDDCCGG(Cit)GRG(Cit)CYGPQCLCRGAGAAGG |
| 222 | KCLPCFTTDHQLLR(Cit)CDDCCGG(Cit)GRG(Cit)CYGPQCLCRGAGAAGG |
| 223 | GCGPCFTTDHQGARKCDDCCGGKGRGKCYGPQCLCR |
| 224 | GCGPCFTTDHQGARACDDCCGGKGRGKCYGPQCLCR |

TABLE 1-continued

Exemplary peptide sequences suitable for use in the compounds of the present disclosure.

| SEQ ID NO. | Polypeptide Sequence |
|---|---|
| 225 | GCGPCFTTDHQGARRCDDCCGGKGRGKCYGPQCLCR |
| 226 | GCGPCFTTDHQGARKCDDCCGGAGRGKCYGPQCLCR |
| 227 | GCGPCFTTDHQGARACDDCCGGAGRGKCYGPQCLCR |
| 228 | GCGPCFTTDHQGARRCDDCCGGAGRGKCYGPQCLCR |
| 229 | GCGPCFTTDHQGARKCDDCCGGRGRGKCYGPQCLCR |
| 230 | GCGPCFTTDHQGARACDDCCGGRGRGKCYGPQCLCR |
| 231 | GCGPCFTTDHQGARRCDDCCGGRGRGKCYGPQCLCR |
| 232 | GCGPCFTTDHQGARKCDDCCGGKGRGACYGPQCLCR |
| 233 | GCGPCFTTDHQGARACDDCCGGKGRGACYGPQCLCR |
| 234 | GCGPCFTTDHQGARRCDDCCGGKGRGACYGPQCLCR |
| 235 | GCGPCFTTDHQGARKCDDCCGGAGRGACYGPQCLCR |
| 236 | GCGPCFTTDHQGARACDDCCGGAGRGACYGPQCLCR |
| 237 | GCGPCFTTDHQGARRCDDCCGGAGRGACYGPQCLCR |
| 238 | GCGPCFTTDHQGARKCDDCCGGRGRGACYGPQCLCR |
| 239 | GCGPCFTTDHQGARACDDCCGGRGRGACYGPQCLCR |
| 240 | GCGPCFTTDHQGARRCDDCCGGRGRGACYGPQCLCR |
| 241 | GCGPCFTTDHQGARKCDDCCGGKGRGRCYGPQCLCR |
| 242 | GCGPCFTTDHQGARACDDCCGGKGRGRCYGPQCLCR |
| 243 | GCGPCFTTDHQGARRCDDCCGGKGRGRCYGPQCLCR |
| 244 | GCGPCFTTDHQGARKCDDCCGGAGRGRCYGPQCLCR |
| 245 | GCGPCFTTDHQGARACDDCCGGAGRGRCYGPQCLCR |
| 246 | GCGPCFTTDHQGARRCDDCCGGAGRGRCYGPQCLCR |
| 247 | GCGPCFTTDHQGARKCDDCCGGRGRGRCYGPQCLCR |
| 248 | GCGPCFTTDHQGARACDDCCGGRGRGRCYGPQCLCR |
| 249 | GCGPCFTTDHQGARRCDDCCGGRGRGRCYGPQCLCR |
| 250 | GCGPCFTTDHQGARRCDDCCGGRGRGRCYGPQCLCR |
| 251 | KCGPCFTTDHQGARRCDDCCGGRGRGRCYGPQCLCR |
| 252 | ACAPCFTTDHQAARRCDDCCGGRGRGRCYGPQCLCR |
| 253 | KCAPCFTTDHQAARRCDDCCGGRGRGRCYGPQCLCR |
| 254 | GCGPCFTTDHQGAR(Cit)CDDCCGG(Cit)GRGKCYGPQCLCR |
| 255 | GCGPCFTTDHQGAR(Cit)CDDCCGG(Cit)GRG(Cit)CYGPQCLCR |
| 256 | KCGPCFTTDHQGAR(Cit)CDDCCGG(Cit)GRG(Cit)CYGPQCLCR |
| 257 | ACAPCFTTDHQAAR(Cit)CDDCCGG(Cit)GRGKCYGPQCLCR |
| 258 | ACAPCFTTDHQAAR(Cit)CDDCCGG(Cit)GRG(Cit)CYGPQCLCR |
| 259 | KCAPCFTTDHQAAR(Cit)CDDCCGG(Cit)GRG(Cit)CYGPQCLCR |
| 260 | ACAPCFTTDHQAARKCDDCCGGKGRGKCYGPQCLCR |
| 261 | ACAPCFTTDHQAARACDDCCGGKGRGKCYGPQCLCR |

TABLE 1-continued

Exemplary peptide sequences suitable for use in the compounds of the present disclosure.

| SEQ ID NO. | Polypeptide Sequence |
|---|---|
| 262 | ACAPCFTTDHQAARRCDDCCGGKGRGKCYGPQCLCR |
| 263 | ACAPCFTTDHQAARKCDDCCGGAGRGKCYGPQCLCR |
| 264 | ACAPCFTTDHQAARACDDCCGGAGRGKCYGPQCLCR |
| 265 | ACAPCFTTDHQAARRCDDCCGGAGRGKCYGPQCLCR |
| 266 | ACAPCFTTDHQAARKCDDCCGGRGRGKCYGPQCLCR |
| 267 | ACAPCFTTDHQAARACDDCCGGRGRGKCYGPQCLCR |
| 268 | ACAPCFTTDHQAARRCDDCCGGRGRGKCYGPQCLCR |
| 269 | ACAPCFTTDHQAARKCDDCCGGKGRGACYGPQCLCR |
| 270 | ACAPCFTTDHQAARACDDCCGGKGRGACYGPQCLCR |
| 271 | ACAPCFTTDHQAARRCDDCCGGKGRGACYGPQCLCR |
| 272 | ACAPCFTTDHQAARKCDDCCGGAGRGACYGPQCLCR |
| 273 | ACAPCFTTDHQAARACDDCCGGAGRGACYGPQCLCR |
| 274 | ACAPCFTTDHQAARRCDDCCGGAGRGACYGPQCLCR |
| 275 | ACAPCFTTDHQAARKCDDCCGGRGRGACYGPQCLCR |
| 276 | ACAPCFTTDHQAARACDDCCGGRGRGACYGPQCLCR |
| 277 | ACAPCFTTDHQAARRCDDCCGGRGRGACYGPQCLCR |
| 278 | ACAPCFTTDHQAARKCDDCCGGKGRGRCYGPQCLCR |
| 279 | ACAPCFTTDHQAARACDDCCGGKGRGRCYGPQCLCR |
| 280 | ACAPCFTTDHQAARRCDDCCGGKGRGRCYGPQCLCR |
| 281 | ACAPCFTTDHQAARKCDDCCGGAGRGRCYGPQCLCR |
| 282 | ACAPCFTTDHQAARACDDCCGGAGRGRCYGPQCLCR |
| 283 | ACAPCFTTDHQAARRCDDCCGGAGRGRCYGPQCLCR |
| 284 | ACAPCFTTDHQAARKCDDCCGGRGRGRCYGPQCLCR |
| 285 | ACAPCFTTDHQAARACDDCCGGRGRGRCYGPQCLCR |
| 286 | ACAPCFTTDHQAARRCDDCCGGRGRGRCYGPQCLCR |
| 287 | ACAPCFTTDHQAARRCDDCCGGRGRGRCYGPQCLCR |
| 288 | KCAPCFTTDHQAARRCDDCCGGRGRGRCYGPQCLCR |
| 289 | ACAPCFTTDHQAARRCDDCCGGRGRGRCYGPQCLCR |
| 290 | KCAPCFTTDHQAARRCDDCCGGRGRGRCYGPQCLCR |
| 291 | ACAPCFTTDHQAAR(Cit)CDDCCGG(Cit)GRGKCYGPQCLCR |
| 292 | ACAPCFTTDHQAAR(Cit)CDDCCGG(Cit)GRG(Cit)CYGPQCLCR |
| 293 | KCAPCFTTDHQAAR(Cit)CDDCCGG(Cit)GRG(Cit)CYGPQCLCR |
| 294 | ACAPCFTTDHQAAR(Cit)CDDCCGG(Cit)GRGKCYGPQCLCR |
| 295 | ACAPCFTTDHQAAR(Cit)CDDCCGG(Cit)GRG(Cit)CYGPQCLCR |
| 296 | KCAPCFTTDHQAAR(Cit)CDDCCGG(Cit)GRG(Cit)CYGPQCLCR |
| 297 | ICIPCFTTDHQIARKCDDCCGGKGRGKCYGPQCLCR |
| 298 | ICIPCFTTDHQIARACDDCCGGKGRGKCYGPQCLCR |

TABLE 1-continued

Exemplary peptide sequences suitable for use in
the compounds of the present disclosure.

| SEQ ID NO. | Polypeptide Sequence |
|---|---|
| 299 | ICIPCFTTDHQIARRCDDCCGGKGRGKCYGPQCLCR |
| 300 | ICIPCFTTDHQIARKCDDCCGGAGRGKCYGPQCLCR |
| 301 | ICIPCFTTDHQIARACDDCCGGAGRGKCYGPQCLCR |
| 302 | ICIPCFTTDHQIARRCDDCCGGAGRGKCYGPQCLCR |
| 303 | ICIPCFTTDHQIARKCDDCCGGRGRGKCYGPQCLCR |
| 304 | ICIPCFTTDHQIARACDDCCGGRGRGKCYGPQCLCR |
| 305 | ICIPCFTTDHQIARRCDDCCGGRGRGKCYGPQCLCR |
| 306 | ICIPCFTTDHQIARKCDDCCGGKGRGACYGPQCLCR |
| 307 | ICIPCFTTDHQIARACDDCCGGKGRGACYGPQCLCR |
| 308 | ICIPCFTTDHQIARRCDDCCGGKGRGACYGPQCLCR |
| 309 | ICIPCFTTDHQIARKCDDCCGGAGRGACYGPQCLCR |
| 310 | ICIPCFTTDHQIARACDDCCGGAGRGACYGPQCLCR |
| 311 | ICIPCFTTDHQIARRCDDCCGGAGRGACYGPQCLCR |
| 312 | ICIPCFTTDHQIARKCDDCCGGRGRGACYGPQCLCR |
| 313 | ICIPCFTTDHQIARACDDCCGGRGRGACYGPQCLCR |
| 314 | ICIPCFTTDHQIARRCDDCCGGRGRGACYGPQCLCR |
| 315 | ICIPCFTTDHQIARKCDDCCGGKGRGRCYGPQCLCR |
| 316 | ICIPCFTTDHQIARACDDCCGGKGRGRCYGPQCLCR |
| 317 | ICIPCFTTDHQIARRCDDCCGGKGRGRCYGPQCLCR |
| 318 | ICIPCFTTDHQIARKCDDCCGGAGRGRCYGPQCLCR |
| 319 | ICIPCFTTDHQIARACDDCCGGAGRGRCYGPQCLCR |
| 320 | ICIPCFTTDHQIARRCDDCCGGAGRGRCYGPQCLCR |
| 321 | ICIPCFTTDHQIARKCDDCCGGRGRGRCYGPQCLCR |
| 322 | ICIPCFTTDHQIARACDDCCGGRGRGRCYGPQCLCR |
| 323 | ICIPCFTTDHQIARRCDDCCGGRGRGRCYGPQCLCR |
| 324 | ICIPCFTTDHQIARRCDDCCGGRGRGRCYGPQCLCR |
| 325 | KCIPCFTTDHQIARRCDDCCGGRGRGRCYGPQCLCR |
| 326 | ACAPCFTTDHQAARRCDDCCGGRGRGRCYGPQCLCR |
| 327 | KCAPCFTTDHQAARRCDDCCGGRGRGRCYGPQCLCR |
| 328 | ICIPCFTTDHQIAR(Cit)CDDCCGG(Cit)GRGKCYGPQCLCR |
| 329 | ICIPCFTTDHQIAR(Cit)CDDCCGG(Cit)GRG(Cit)CYGPQCLCR |
| 330 | KCIPCFTTDHQIAR(Cit)CDDCCGG(Cit)GRG(Cit)CYGPQCLCR |
| 331 | ACAPCFTTDHQAAR(Cit)CDDCCGG(Cit)GRGKCYGPQCLCR |
| 332 | ACAPCFTTDHQAAR(Cit)CDDCCGG(Cit)GRG(Cit)CYGPQCLCR |
| 333 | KCAPCFTTDHQAAR(Cit)CDDCCGG(Cit)GRG(Cit)CYGPQCLCR |
| 334 | TCTPCFTTDHQTARKCDDCCGGKGRGKCYGPQCLCR |
| 335 | TCTPCFTTDHQTARACDDCCGGKGRGKCYGPQCLCR |

TABLE 1-continued

Exemplary peptide sequences suitable for use in the compounds of the present disclosure.

| SEQ ID NO. | Polypeptide Sequence |
|---|---|
| 336 | TCTPCFTTDHQTARRCDDCCGGKGRGKCYGPQCLCR |
| 337 | TCTPCFTTDHQTARKCDDCCGGAGRGKCYGPQCLCR |
| 338 | TCTPCFTTDHQTARACDDCCGGAGRGKCYGPQCLCR |
| 339 | TCTPCFTTDHQTARRCDDCCGGAGRGKCYGPQCLCR |
| 340 | TCTPCFTTDHQTARKCDDCCGGRGRGKCYGPQCLCR |
| 341 | TCTPCFTTDHQTARACDDCCGGRGRGKCYGPQCLCR |
| 342 | TCTPCFTTDHQTARRCDDCCGGRGRGKCYGPQCLCR |
| 343 | TCTPCFTTDHQTARKCDDCCGGKGRGACYGPQCLCR |
| 344 | TCTPCFTTDHQTARACDDCCGGKGRGACYGPQCLCR |
| 345 | TCTPCFTTDHQTARRCDDCCGGKGRGACYGPQCLCR |
| 346 | TCTPCFTTDHQTARKCDDCCGGAGRGACYGPQCLCR |
| 347 | TCTPCFTTDHQTARACDDCCGGAGRGACYGPQCLCR |
| 348 | TCTPCFTTDHQTARRCDDCCGGAGRGACYGPQCLCR |
| 349 | TCTPCFTTDHQTARKCDDCCGGRGRGACYGPQCLCR |
| 350 | TCTPCFTTDHQTARACDDCCGGRGRGACYGPQCLCR |
| 351 | TCTPCFTTDHQTARRCDDCCGGRGRGACYGPQCLCR |
| 352 | TCTPCFTTDHQTARKCDDCCGGKGRGRCYGPQCLCR |
| 353 | TCTPCFTTDHQTARACDDCCGGKGRGRCYGPQCLCR |
| 354 | TCTPCFTTDHQTARRCDDCCGGKGRGRCYGPQCLCR |
| 355 | TCTPCFTTDHQTARKCDDCCGGAGRGRCYGPQCLCR |
| 356 | TCTPCFTTDHQTARACDDCCGGAGRGRCYGPQCLCR |
| 357 | TCTPCFTTDHQTARRCDDCCGGAGRGRCYGPQCLCR |
| 358 | TCTPCFTTDHQTARKCDDCCGGRGRGRCYGPQCLCR |
| 359 | TCTPCFTTDHQTARACDDCCGGRGRGRCYGPQCLCR |
| 360 | TCTPCFTTDHQTARRCDDCCGGRGRGRCYGPQCLCR |
| 361 | TCTPCFTTDHQTARRCDDCCGGRGRGRCYGPQCLCR |
| 362 | KCTPCFTTDHQTARRCDDCCGGRGRGRCYGPQCLCR |
| 363 | ACAPCFTTDHQAARRCDDCCGGRGRGRCYGPQCLCR |
| 364 | KCAPCFTTDHQAARRCDDCCGGRGRGRCYGPQCLCR |
| 365 | TCTPCFTTDHQTAR(Cit)CDDCCGG(Cit)GRGKCYGPQCLCR |
| 366 | TCTPCFTTDHQTAR(Cit)CDDCCGG(Cit)GRG(Cit)CYGPQCLCR |
| 367 | KCTPCFTTDHQTAR(Cit)CDDCCGG(Cit)GRG(Cit)CYGPQCLCR |
| 368 | ACAPCFTTDHQAAR(Cit)CDDCCGG(Cit)GRGKCYGPQCLCR |
| 369 | ACAPCFTTDHQAAR(Cit)CDDCCGG(Cit)GRG(Cit)CYGPQCLCR |
| 370 | KCAPCFTTDHQAAR(Cit)CDDCCGG(Cit)GRG(Cit)CYGPQCLCR |
| 371 | VCVPCFTTDHQVARKCDDCCGGKGRGKCYGPQCLCR |
| 372 | VCVPCFTTDHQVARACDDCCGGKGRGKCYGPQCLCR |

TABLE 1-continued

Exemplary peptide sequences suitable for use in the compounds of the present disclosure.

| SEQ ID NO. | Polypeptide Sequence |
|---|---|
| 373 | VCVPCFTTDHQVARRCDDCCGGKGRGKCYGPQCLCR |
| 374 | VCVPCFTTDHQVARKCDDCCGGAGRGKCYGPQCLCR |
| 375 | VCVPCFTTDHQVARACDDCCGGAGRGKCYGPQCLCR |
| 376 | VCVPCFTTDHQVARRCDDCCGGAGRGKCYGPQCLCR |
| 377 | VCVPCFTTDHQVARKCDDCCGGRGRGKCYGPQCLCR |
| 378 | VCVPCFTTDHQVARACDDCCGGRGRGKCYGPQCLCR |
| 379 | VCVPCFTTDHQVARRCDDCCGGRGRGKCYGPQCLCR |
| 380 | VCVPCFTTDHQVARKCDDCCGGKGRGACYGPQCLCR |
| 381 | VCVPCFTTDHQVARACDDCCGGKGRGACYGPQCLCR |
| 382 | VCVPCFTTDHQVARRCDDCCGGKGRGACYGPQCLCR |
| 383 | VCVPCFTTDHQVARKCDDCCGGAGRGACYGPQCLCR |
| 384 | VCVPCFTTDHQVARACDDCCGGAGRGACYGPQCLCR |
| 385 | VCVPCFTTDHQVARRCDDCCGGAGRGACYGPQCLCR |
| 386 | VCVPCFTTDHQVARKCDDCCGGRGRGACYGPQCLCR |
| 387 | VCVPCFTTDHQVARACDDCCGGRGRGACYGPQCLCR |
| 388 | VCVPCFTTDHQVARRCDDCCGGRGRGACYGPQCLCR |
| 389 | VCVPCFTTDHQVARKCDDCCGGKGRGRCYGPQCLCR |
| 390 | VCVPCFTTDHQVARACDDCCGGKGRGRCYGPQCLCR |
| 391 | VCVPCFTTDHQVARRCDDCCGGKGRGRCYGPQCLCR |
| 392 | VCVPCFTTDHQVARKCDDCCGGAGRGRCYGPQCLCR |
| 393 | VCVPCFTTDHQVARACDDCCGGAGRGRCYGPQCLCR |
| 394 | VCVPCFTTDHQVARRCDDCCGGAGRGRCYGPQCLCR |
| 395 | VCVPCFTTDHQVARKCDDCCGGRGRGRCYGPQCLCR |
| 396 | VCVPCFTTDHQVARACDDCCGGRGRGRCYGPQCLCR |
| 397 | VCVPCFTTDHQVARRCDDCCGGRGRGRCYGPQCLCR |
| 398 | VCVPCFTTDHQVARRCDDCCGGRGRGRCYGPQCLCR |
| 399 | KCVPCFTTDHQVARRCDDCCGGRGRGRCYGPQCLCR |
| 400 | ACAPCFTTDHQAARRCDDCCGGRGRGRCYGPQCLCR |
| 401 | KCAPCFTTDHQAARRCDDCCGGRGRGRCYGPQCLCR |
| 402 | VCVPCFTTDHQVAR(Cit)CDDCCGG(Cit)GRGKCYGPQCLCR |
| 403 | VCVPCFTTDHQVAR(Cit)CDDCCGG(Cit)GRG(Cit)CYGPQCLCR |
| 404 | KCVPCFTTDHQVAR(Cit)CDDCCGG(Cit)GRG(Cit)CYGPQCLCR |
| 405 | ACAPCFTTDHQAAR(Cit)CDDCCGG(Cit)GRGKCYGPQCLCR |
| 406 | ACAPCFTTDHQAAR(Cit)CDDCCGG(Cit)GRG(Cit)CYGPQCLCR |
| 407 | KCAPCFTTDHQAAR(Cit)CDDCCGG(Cit)GRG(Cit)CYGPQCLCR |
| 408 | LCLPCFTTDHQLARKCDDCCGGKGRGKCYGPQCLCR |
| 409 | LCLPCFTTDHQLARACDDCCGGKGRGKCYGPQCLCR |

TABLE 1-continued

Exemplary peptide sequences suitable for use in the compounds of the present disclosure.

| SEQ ID NO. | Polypeptide Sequence |
|---|---|
| 410 | LCLPCFTTDHQLARRCDDCCGGKGRGKCYGPQCLCR |
| 411 | LCLPCFTTDHQLARKCDDCCGGAGRGKCYGPQCLCR |
| 412 | LCLPCFTTDHQLARACDDCCGGAGRGKCYGPQCLCR |
| 413 | LCLPCFTTDHQLARRCDDCCGGAGRGKCYGPQCLCR |
| 414 | LCLPCFTTDHQLARKCDDCCGGRGRGKCYGPQCLCR |
| 415 | LCLPCFTTDHQLARACDDCCGGRGRGKCYGPQCLCR |
| 416 | LCLPCFTTDHQLARRCDDCCGGRGRGKCYGPQCLCR |
| 417 | LCLPCFTTDHQLARKCDDCCGGKGRGACYGPQCLCR |
| 418 | LCLPCFTTDHQLARACDDCCGGKGRGACYGPQCLCR |
| 419 | LCLPCFTTDHQLARRCDDCCGGKGRGACYGPQCLCR |
| 420 | LCLPCFTTDHQLARKCDDCCGGAGRGACYGPQCLCR |
| 421 | LCLPCFTTDHQLARACDDCCGGAGRGACYGPQCLCR |
| 422 | LCLPCFTTDHQLARRCDDCCGGAGRGACYGPQCLCR |
| 423 | LCLPCFTTDHQLARKCDDCCGGRGRGACYGPQCLCR |
| 424 | LCLPCFTTDHQLARACDDCCGGRGRGACYGPQCLCR |
| 425 | LCLPCFTTDHQLARRCDDCCGGRGRGACYGPQCLCR |
| 426 | LCLPCFTTDHQLARKCDDCCGGKGRGRCYGPQCLCR |
| 427 | LCLPCFTTDHQLARACDDCCGGKGRGRCYGPQCLCR |
| 428 | LCLPCFTTDHQLARRCDDCCGGKGRGRCYGPQCLCR |
| 429 | LCLPCFTTDHQLARKCDDCCGGAGRGRCYGPQCLCR |
| 430 | LCLPCFTTDHQLARACDDCCGGAGRGRCYGPQCLCR |
| 431 | LCLPCFTTDHQLARRCDDCCGGAGRGRCYGPQCLCR |
| 432 | LCLPCFTTDHQLARKCDDCCGGRGRGRCYGPQCLCR |
| 433 | LCLPCFTTDHQLARACDDCCGGRGRGRCYGPQCLCR |
| 434 | LCLPCFTTDHQLARRCDDCCGGRGRGRCYGPQCLCR |
| 435 | LCLPCFTTDHQLARRCDDCCGGRGRGRCYGPQCLCR |
| 436 | KCLPCFTTDHQLARRCDDCCGGRGRGRCYGPQCLCR |
| 437 | ACAPCFTTDHQAARRCDDCCGGRGRGRCYGPQCLCR |
| 438 | KCAPCFTTDHQAARRCDDCCGGRGRGRCYGPQCLCR |
| 439 | LCLPCFTTDHQLAR(Cit)CDDCCGG(Cit)GRGKCYGPQCLCR |
| 440 | LCLPCFTTDHQLAR(Cit)CDDCCGG(Cit)GRG(Cit)CYGPQCLCR |
| 441 | KCLPCFTTDHQLAR(Cit)CDDCCGG(Cit)GRG(Cit)CYGPQCLCR |
| 442 | ACAPCFTTDHQAAR(Cit)CDDCCGG(Cit)GRGKCYGPQCLCR |
| 443 | ACAPCFTTDHQAAR(Cit)CDDCCGG(Cit)GRG(Cit)CYGPQCLCR |
| 444 | KCAPCFTTDHQAAR(Cit)CDDCCGG(Cit)GRG(Cit)CYGPQCLCR |
| 445 | SCSPCFTTDHQSARKCDDCCGGKGRGKCYGPQCLCR |
| 446 | SCSPCFTTDHQSARACDDCCGGKGRGKCYGPQCLCR |

TABLE 1-continued

Exemplary peptide sequences suitable for use in the compounds of the present disclosure.

| SEQ ID NO. | Polypeptide Sequence |
|---|---|
| 447 | SCSPCFTTDHQSARRCDDCCGGKGRGKCYGPQCLCR |
| 448 | SCSPCFTTDHQSARKCDDCCGGAGRGKCYGPQCLCR |
| 449 | SCSPCFTTDHQSARACDDCCGGAGRGKCYGPQCLCR |
| 450 | SCSPCFTTDHQSARRCDDCCGGAGRGKCYGPQCLCR |
| 451 | SCSPCFTTDHQSARKCDDCCGGRGRGKCYGPQCLCR |
| 452 | SCSPCFTTDHQSARACDDCCGGRGRGKCYGPQCLCR |
| 453 | SCSPCFTTDHQSARRCDDCCGGRGRGKCYGPQCLCR |
| 454 | SCSPCFTTDHQSARKCDDCCGGKGRGACYGPQCLCR |
| 455 | SCSPCFTTDHQSARACDDCCGGKGRGACYGPQCLCR |
| 456 | SCSPCFTTDHQSARRCDDCCGGKGRGACYGPQCLCR |
| 457 | SCSPCFTTDHQSARKCDDCCGGAGRGACYGPQCLCR |
| 458 | SCSPCFTTDHQSARACDDCCGGAGRGACYGPQCLCR |
| 459 | SCSPCFTTDHQSARRCDDCCGGAGRGACYGPQCLCR |
| 460 | SCSPCFTTDHQSARKCDDCCGGRGRGACYGPQCLCR |
| 461 | SCSPCFTTDHQSARACDDCCGGRGRGACYGPQCLCR |
| 462 | SCSPCFTTDHQSARRCDDCCGGRGRGACYGPQCLCR |
| 463 | SCSPCFTTDHQSARKCDDCCGGKGRGRCYGPQCLCR |
| 464 | SCSPCFTTDHQSARACDDCCGGKGRGRCYGPQCLCR |
| 465 | SCSPCFTTDHQSARRCDDCCGGKGRGRCYGPQCLCR |
| 466 | SCSPCFTTDHQSARKCDDCCGGAGRGRCYGPQCLCR |
| 467 | SCSPCFTTDHQSARACDDCCGGAGRGRCYGPQCLCR |
| 468 | SCSPCFTTDHQSARRCDDCCGGAGRGRCYGPQCLCR |
| 469 | SCSPCFTTDHQSARKCDDCCGGRGRGRCYGPQCLCR |
| 470 | SCSPCFTTDHQSARACDDCCGGRGRGRCYGPQCLCR |
| 471 | SCSPCFTTDHQSARRCDDCCGGRGRGRCYGPQCLCR |
| 472 | SCSPCFTTDHQSARRCDDCCGGRGRGRCYGPQCLCR |
| 473 | KCSPCFTTDHQSARRCDDCCGGRGRGRCYGPQCLCR |
| 474 | ACAPCFTTDHQAARRCDDCCGGRGRGRCYGPQCLCR |
| 475 | KCAPCFTTDHQAARRCDDCCGGRGRGRCYGPQCLCR |
| 476 | SCSPCFTTDHQSAR(Cit)CDDCCGG(Cit)GRGKCYGPQCLCR |
| 477 | SCSPCFTTDHQSAR(Cit)CDDCCGG(Cit)GRG(Cit)CYGPQCLCR |
| 478 | KCSPCFTTDHQSAR(Cit)CDDCCGG(Cit)GRG(Cit)CYGPQCLCR |
| 479 | ACAPCFTTDHQAAR(Cit)CDDCCGG(Cit)GRGKCYGPQCLCR |
| 480 | ACAPCFTTDHQAAR(Cit)CDDCCGG(Cit)GRG(Cit)CYGPQCLCR |
| 481 | KCAPCFTTDHQAAR(Cit)CDDCCGG(Cit)GRG(Cit)CYGPQCLCR |

Cit = Citrulline.

Chlorotoxin conjugates comprise a chlorotoxin and a labeling agent or detectable label. In an embodiment, chlorotoxin is a variant comprising at least 60%, 65%, 70%, 75%, 80%, 83%, 85%, 86%, 89%, 90%, 92%, 93%, 94%, 95%, 96%, 97%, 98%, or 99% identical to the sequence of the natural peptide of chlorotoxin. In another embodiment, the present disclosure provides a chlorotoxin having the following amino acid sequence: MCMPCFTTDHQ-MARKCDDCCGGKGRGKCYGPQCLCR. In a further embodiment, the present disclosure provides chlorotoxin variants comprising at least 60%, 65%, 70%, 75%, 80%, 83%, 85%, 86%, 89%, 90%, 92%, 93%, 94%, 95%, 96%, 97%, 98%, or 99% identical to the following amino acid sequence: MCMPCFTTDHQ-MARKCDDCCGGKGRGKCYGPQCLCR. In another embodiment, the chlorotoxin is a chlorotoxin or variant thereof comprising at least 60%, 65%, 70%, 75%, 800%, 83%, 85%, 86%, 89%, 90%, 92%, 93%, 94%, 95%, 960%, 97%, 98%, or 99% sequence identity to the sequence of MCMPCFTTDHQMARXCDDCCGGXGRGXCYGPQCL-CR, wherein X is selected from K, A and R. In another embodiment, the chlorotoxin is a chlorotoxin or variant of thereof comprising at least 85% sequence identity to the sequence of MCMPCFTTDHQMARXCDDCCGGXGRGXCYGPQCL-CR, wherein X is selected from K, A and R.

In another embodiment, the chlorotoxin is BLZ-100, which is a chlorotoxin variant comprising the sequence of MCMPCFTTDHQMARXCDDCCGGXGRGXCYGPQCL-CR, wherein X15 and X23 are arginine and X27 is lysine conjugated to a cyanine fluorescent label. The peptide can be further cross-linked by four disulfide bonds formed among the cysteine residues present in the sequence.

In some aspects, the peptide is a variant of the natural peptide of chlorotoxin but retains all eight cysteine residues of the natural peptide, enabling cross-linking by up to four disulfide bonds. Conservation of cysteine residues helps to preserve the secondary structure, charge distribution, isoelectric point (pI) and other features of the natural chlorotoxin peptide because of the disulfide bonds that form between the cysteine residues.

In some aspects, the chlorotoxin peptide variant retains all eight cysteine residues of the natural peptide and has at least 40%, 45%, 50%, 55%, 60%, 65%, 70%, 75%, 80%, 83%, 85%, 86%, 89%, 90%, 92%, 93%, 94%, 95%, 96%, 97%, 98%, or 99% sequence identity with the native chlorotoxin peptide.

In some aspects, the chlorotoxin peptide variant has eight cysteine residues positioned so that the distances between pairs of cysteines is the same as the distances between pairs of cysteines found in the natural peptide, and the chlorotoxin peptide variant has at least 40%, 45%, 50%, 55%, 60%, 65%, 70%, 75%, 80%, 83%, 85%, 86%, 89%, 90%, 92%, 93%, 94%, 95%, 96%, 97%, 98%, or 99% sequence identity with the native chlorotoxin peptide.

In some aspects, the chlorotoxin peptide variant has eight cysteine residues positioned so that the distances between pairs of cysteines is functionally equivalent or functionally similar to the distances between pairs of cysteines found in the natural peptide, and the chlorotoxin peptide variant has at least 40%, 45%, 50%, 55%, 60%, 65%, 70%, 75%, 80%, 83%, 85%, 86%, 89%, 90%, 92%, 93%, 94%, 95%, 96%, 97%, 98%, or 99% sequence identity with the native chlorotoxin peptide.

In some aspects, the chlorotoxin peptide variant has eight cysteine residues positioned so that the distances between pairs of cysteines allows for secondary structure and isoelectric point of the native chlorotoxin peptide to be preserved, and the chlorotoxin peptide variant has at least 40%, 45%, 50%, 55%, 60%, 65%, 70%, 75%, 80%, 83%, 85%, 86%, 89%, 90%, 92%, 93%, 94%, 95%, 96%, 97%, 98%, or 99% sequence identity with the native chlorotoxin peptide.

In some aspects, the chlorotoxin peptide variant has eight cysteine residues positioned so that the distances between pairs of cysteines is sufficient to allow disulfide bonds to form, and the chlorotoxin peptide variant has at least 40%, 45%, 50%, 55%, 60%, 65%, 70%, 75%, 80%, 83%, 85%, 86%, 89%, 90%, 92%, 93%, 94%, 95%, 96%, 97%, 98%, or 99% sequence identity with the native chlorotoxin peptide.

In some aspects, one or more methionines of the chlorotoxin peptide variant are replaced with other amino acids. In some aspects, one or more methionines of the chlorotoxin peptide variant are replaced with other amino acids selected from glycine, alanine, Isoleucine, Threonine, Valine, Leucine, Serine or a combination thereof.

In some embodiments, the chlorotoxin can be a chlorotoxin variant. Chlorotoxin and chlorotoxin variants have are further described in PCT Patent Application Publication Numbers WO2006115633 and WO2011142858, which are incorporated in their entirety herein by reference.

In one embodiment, the peptide can have the following formula: H-Met-Cys-Met-Pro-Cys-Phe-Thr-Thr-Asp-His-Gln-Met-Ala-Arg-Xaa-Cys-Asp-Asp-Cys-Cys-Gly-Gly-Xaa-Gly-Arg-Gly-Xaa-Cys-Tyr-Gly-Pro-Gln-Cys-Leu-Cys-Arg-OH acetate salt (disulfide bonds, air oxidized), wherein Xaa is Arg, Ala, or Lys.

In another embodiment, the all peptide can have the following formula: H-Met-Cys-Met-Pro-Cys-Phe-Thr-Thr-Asp-His-Gln-Met-Ala-Arg-Xaa-Cys-Asp-Asp-Cys-Cys-Gly-Gly-Xaa-Gly-Arg-Gly-Lys-Cys-Tyr-Gly-Pro-Gln-Cys-Leu-Cys-Arg-OH acetate salt (disulfide bonds, air oxidized), wherein Xaa is Arg, or Ala.

In another embodiment, the peptide can have the following formula: H-Met-Cys-Met-Pro-Cys-Phe-Thr-Thr-Asp-His-Gln-Met-Ala-Arg-Arg-Cys-Asp-Asp-Cys-Cys-Gly-Gly-Arg-Gly-Arg-Gly-Lys-Cys-Tyr-Gly-Pro-Gln-Cys-Leu-Cys-Arg-OH acetate salt (disulfide bonds, air oxidized).

In another embodiment, the peptide can have the following formula: H-Met-Cys-Met-Pro-Cys-Phe-Thr-Thr-Asp-His-Gln-Met-Ala-Arg-Arg-Cys-Asp-Asp-Cys-Cys-Gly-Gly-Ala-Gly-Arg-Gly-Lys-Cys-Tyr-Gly-Pro-Gln-Cys-Leu-Cys-Arg-OH acetate salt (disulfide bonds, air oxidized).

In another embodiment, the peptide can have the following formula: H-Met-Cys-Met-Pro-Cys-Phe-Thr-Thr-Asp-His-Gln-Met-Ala-Arg-Ala-Cys-Asp-Asp-Cys-Cys-Gly-Gly-Arg-Gly-Arg-Gly-Lys-Cys-Tyr-Gly-Pro-Gln-Cys-Leu-Cys-Arg-OH acetate salt (disulfide bonds, air oxidized).

In another embodiment, the peptide can have the following formula: H-Met-Cys-Met-Pro-Cys-Phe-Thr-Thr-Asp-His-Gln-Met-Ala-Arg-Ala-Cys-Asp-Asp-Cys-Cys-Gly-Gly-Ala-Gly-Arg-Gly-Lys-Cys-Tyr-Gly-Pro-Gln-Cys-Leu-Cys-Arg-OH acetate salt (disulfide bonds, air oxidized).

In certain embodiments, the chlorotoxin and chlorotoxin variants can be conjugated to moieties, such as detectable labels (e.g., dyes) that can be detected (e.g., visualized) in a subject. In some embodiments, the chlorotoxin and/or chlorotoxin variants can be conjugated to detectable labels to enable tracking of the bio-distribution of a conjugated peptide. The detectable labels can include fluorescent dyes. Non-limiting examples of fluorescent dyes that could be used as a conjugating molecule in the present disclosure include rhodamine, rhodol, fluorescein, thiofluorescein, aminofluorescein, carboxyfluorescein, chlorofluorescein, methylfluorescein, sulfofluorescein, aminorhodol, carboxyrhodol, chlororhodol, methylrhodol, sulforhodol; aminorhodamine, carboxyrhodamine, chlororhodamine, methylrhodamine, sulforhodamine, and thiorhodamine, cyanine, indocarbocyanine, oxacarbocyanine, thiacarbocyanine, merocyanine, a cyanine dye (e.g., cyanine 2, cyanine 3, cyanine 3.5, cyanine 5, cyanine 5.5, cyanine 7), oxadiazole derivatives, pyridyloxazole, nitrobenzoxadiazole, benzoxadiazole, pyrene derivatives, cascade blue, oxazine derivatives, Nile red, Nile blue, cresyl violet, oxazine 170, acridine derivatives, proflavin, acridine orange, acridine yellow, arylmethine derivatives, auramine, xanthene dyes, sulfonated xanthenes dyes, Alexa Fluors (e.g., Alexa Fluor 594, Alexa Fluor 633, Alexa Fluor 647, Alexa Fluor 700), crystal violet, malachite green, tetrapyrrole derivatives, porphyrin, phtalocyanine, and bilirubin. Some other example dyes include near-infrared dyes, such as, but not limited to, Cy5.5, indocyanine green (ICG), DyLight 750 or IRdye 800. In some embodiments, near infrared dyes can include cyanine dyes.

Chemotherapueutics, anti-cancer drugs, and anti-cancer agents, include, but are not limited to: radioisotopes, toxins, enzymes, sensitizing drugs, nucleic acids, including interfering RNAs, antibodies, anti-angiogenic agents, cisplatin, anti-metabolites, mitotic inhibitors, growth factor inhibitors, paclitaxel, temozolomide, topotecan, fluorouracil, vincristine, vinblastine, procarbazine, decarbazine, altretamine, methotrexate, mercaptopurine, thioguanine, fludarabine phosphate, cladribine, pentostatin, cytarabine, azacitidine, etoposide, teniposide, irinotecan, docetaxel, doxorubicin, daunorubicin, dactinomycin, idarubicin, plicamycin, mitomycin, bleomycin, tamoxifen, flutamide, leuprolide, goserelin, aminogluthimide, anastrozole, amsacrine, asparaginase, mitoxantrone, mitotane and amifostine, and their equivalents, as well as photo-ablation.

As used herein, the terms "about" and "approximately," in reference to a number, is used herein to include numbers that fall within a range of 10%, 5%, or 1% in either direction (greater than or less than) the number unless otherwise stated or otherwise evident from the context (except where such number would exceed 100% of a possible value).

Suitable diagnostic agents include agents that provide for the detection by fluorescence methods as well as methods other than fluorescence imaging. Other suitable diagnostic agents include radiolabels (e.g., radio isotopically labeled compounds) such as $^{125}I$, $^{14}C$, and $^{31}P$, among others; and magnetic resonance imaging agents.

Suitable targeting agents include antibodies, polypeptides, polysaccharides, and nucleic acids.

In another aspect of the invention, compositions that include the modified chlorotoxin peptide conjugates are provided. The composition can include a pharmaceutically acceptable carrier or diluent for delivery of the modified chlorotoxin peptide conjugate. Suitable pharmaceutically acceptable carriers or diluents include saline or dextrose for injection.

In various aspects, the presently described compounds further comprise a detectable label, which can be used for the detection of the peptide-label conjugate and the cancerous cells to which they are bound.

In various aspects, compounds of the present disclosure have the structure of Formula (I), or a pharmaceutically acceptable salt thereof:

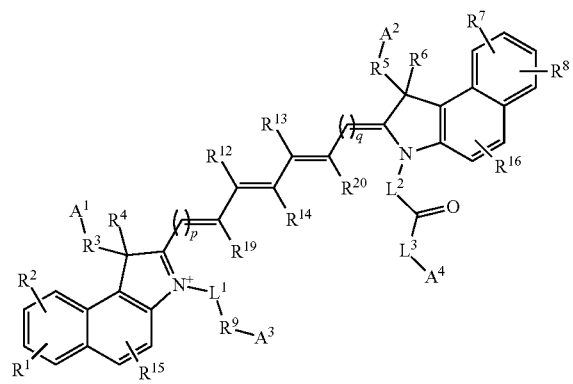

(I)

wherein:
$R^1$, $R^2$, $R^3$, $R^4$, $R^5$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —$SO_2$—$NH_2$, $C_1$-$C_6$ alkoxy, $C_1$-$C_{10}$ alkylene-$(C(=O))_x$—, $C_1$-$C_{10}$ alkylene-$(C(=O))_x$—O—, or $C_1$-$C_{10}$ alkylene-$(C(=O))_x$—$NR^{10}$— $R^9$ is hydrogen, sulfonate, —COOH, $C_1$-$C_{10}$ alkylene-$(C(=O))_x$—, $C_1$-$C_{10}$ alkylene-$(C(=O))_x$—O—, or $C_1$-$C_{10}$ alkylene-$(C(=O))_x$—$NR^{10}$—;

$L^1$ is $C_3$-$C_6$ alkylene;
$L^2$ is $C_1$-$C_{10}$ alkylene;
$L^3$ is a bond, —O—, —$NR^{10}$—, —$NR^{10}$—$C_1$-$C_6$ alkylene-, —O—$NR^{10}$—, —$NR^{10}$—$C_1$-$C_6$ alkylene-(O—$C_1$-$C_6$ alkylene)$_n$-, —$NR^{10}$-$L^4$-, —$NR^{10}$—$C_1$-$C_6$ alkylene-$NR^{11}$—$(C(=O)$—$C_1$-$C_6$ alkylene-O—$)_m$—, or —$NR^{10}$—$C_1$-$C_6$ alkylene-$NR^{10}$—$C_1$-$C_6$ alkylene-$NR^{10}$—$C_1$-$C_6$ alkylene-;

$L^4$ is a bond, -heterocyclyl-, or -heterocyclyl-$C_1$-$C_6$ alkylene-;
$R^{10}$ is hydrogen or $C_1$-$C_6$ alkyl;
$R^{11}$ is hydrogen or $C_1$-$C_6$ alkyl;
$R^{12}$ and $R^{13}$ are each independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring;
$R^{14}$ is hydrogen or $C_1$-$C_6$ alkylene, -$(L^5)$-aryl, -$(L^5)$-aryl-$A^5$, -$(L^5)$-heteroaryl, -$(L^5)$-heteroaryl-$A^5$, —$NR^{17}R^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;
$L^5$ is a bond, $C_1$-$C_{10}$ alkylene, —O—, or —$NR^{10}$—;
$R^{17}$ and $R^{18}$ are each independently hydrogen or aryl;
$R^{19}$ and $R^{20}$ are each independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;
n is 0, 1, 2, or 3;
m is 0, 1, 2, or 3;
p is 0, 1, 2, or 3;

q is 0, 1, 2, or 3;

x is 0 or 1; and one of $A^1$, $A^2$, $A^3$, $A^4$, or $A^5$ is a polypeptide having at least 85% sequence identity with MCMPCFTTDHQMARRCDDCCGGR-GRGKCYGPQCLCR or a fragment thereof and the others of $A^1$, $A^2$, $A^3$, $A^4$, or $A^5$ are each independently absent, hydrogen, —COOH, or sulfonate.

In various aspects, the presently described compounds further comprise a detectable label, which can be used for the detection of the peptide-label conjugate and the cancerous cells to which they are bound.

In various aspects, compounds of the present disclosure have the structure of Formula (XV), or a pharmaceutically acceptable salt thereof:

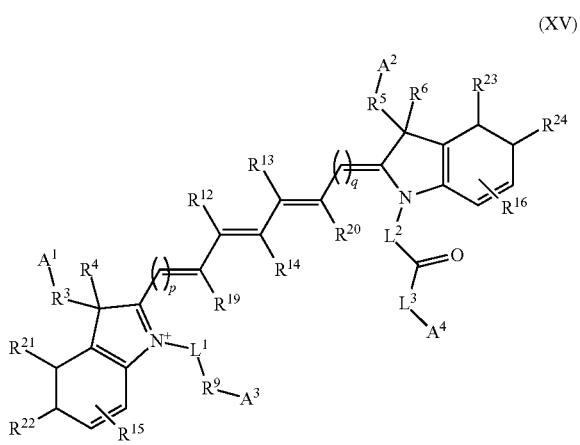

(XV)

wherein:

$R^3$, $R^4$, $R^5$, $R^6$, $R^{15}$, and $R^{16}$ are each independently selected from hydrogen, $C_1$-$C_6$ alkyl, $C_1$-$C_6$ alkylene-COOH, sulfonate, —COOH, —SO$_2$—NH$_2$, $C_1$-$C_6$ alkoxy, $C_1$-$C_{10}$ alkylene-(C(=O))$_x$—, $C_1$-$C_{10}$ alkylene-(C(=O))$_x$—O—, or $C_1$-$C_{10}$ alkylene-(C(=O))$_x$—NR$^{10}$—;

$R^9$ is hydrogen, sulfonate, —COOH, $C_1$-$C_{10}$ alkylene-(C(=O))$_x$—, $C_1$-$C_{10}$ alkylene-(C(=O))$_x$—O—, or $C_1$-$C_{10}$ alkylene-(C(=O))$_x$—NR$^{10}$—;

$L^1$ is $C_3$-$C_6$ alkylene;

$L^2$ is $C_1$-$C_{10}$ alkylene;

$L^3$ is a bond, —O—, —NR$^{10}$—, —NR$^{10}$—$C_1$-$C_6$ alkylene-, —O—NR$^{10}$—, —NR$^{10}$—$C_1$-$C_6$ alkylene-(O—$C_1$-$C_6$ alkylene)$_n$-, —NR$^{10}$-$L^4$-, —NR$^{10}$—$C_1$-$C_6$ alkylene-NR$^{11}$—(C(=O)—$C_1$-$C_6$ alkylene-O—)$_m$—, or —NR$^{10}$—$C_1$-$C_6$ alkylene-NR$^{10}$—$C_1$-$C_6$ alkylene-NR$^{10}$—$C_1$-$C_6$ alkylene-;

$L^4$ is a bond, -heterocyclyl-, or -heterocyclyl-$C_1$-$C_6$ alkylene-;

$R^{10}$ is hydrogen or $C_1$-$C_6$ alkyl;

$R^{11}$ is hydrogen or $C_1$-$C_6$ alkyl;

$R^{12}$ and $R^{13}$ are each independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring;

$R^{14}$ is hydrogen or $C_1$-$C_6$ alkylene, -(L$^5$)-aryl, -(L$^5$)-aryl-$A^5$, -(L$^5$)-heteroaryl, -(L$^5$)-heteroaryl-$A^5$, —NR$^{17}$R$^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;

$L^5$ is a bond, $C_1$-$C_{10}$ alkylene, —O—, or —NR$^{10}$—;

$R^{17}$ and $R^{18}$ are each independently hydrogen or aryl;

$R^{19}$ and $R^{20}$ are each independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;

$R^{21}$ and $R^{22}$ are each independently selected from hydrogen, $C_1$-$C_6$ alkyl, sulfonate, or $R^{21}$ and $R^{22}$ are joined together along with the other atoms to which they are attached to form a 5-membered or 6-membered aryl;

$R^{23}$ and $R^{24}$ are each independently selected from hydrogen, $C_1$-$C_6$ alkyl, sulfonate, or $R^{23}$ and $R^{24}$ are joined together along with the other atoms to which they are attached to form a 5-membered or 6-membered aryl;

n is 0, 1, 2, or 3;

m is 0, 1, 2, or 3;

p is 0, 1, 2, or 3;

q is 0, 1, 2, or 3;

x is 0 or 1; and one of $A^1$, $A^2$, $A^3$, $A^4$, or $A^5$ is a polypeptide having at least 85% sequence identity with MCMPCFTTDHQMARRCDDCCGGR-GRGKCYGPQCLCR or a fragment thereof and the others of $A^1$, $A^2$, $A^3$, $A^4$, or $A^5$ are each independently absent, hydrogen, —COOH, or sulfonate.

In some aspects, the compounds of the present disclosure have a structure of Formula (II), or a pharmaceutically acceptable salt thereof:

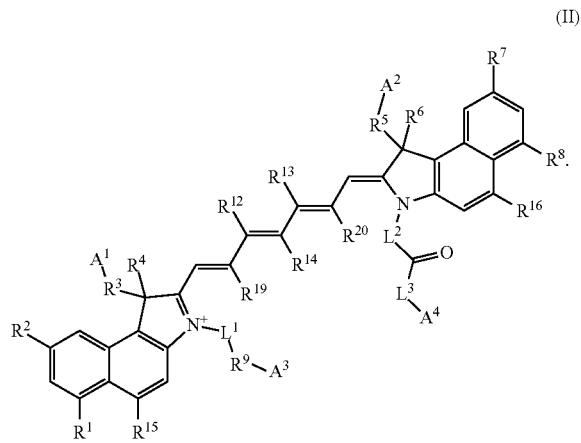

(II)

In certain aspects, the present compounds have a structure of Formula (III), or a pharmaceutically acceptable salt thereof:

(III)

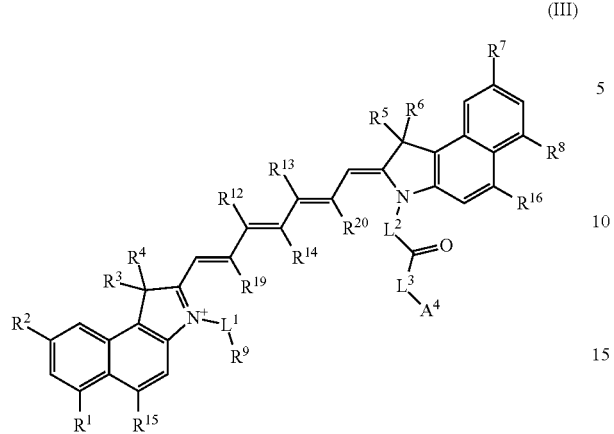

wherein:
- $R^1$, $R^2$, $R^3$, $R^4$, $R^5$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —$SO_2$—$NH_2$, or $C_1$-$C_6$ alkoxy;
- $R^9$ is hydrogen, sulfonate, or —COOH;
- $L^1$ is $C_3$-$C_6$ alkylene;
- $L^2$ is $C_1$-$C_{10}$ alkylene;
- $L^3$ is a bond, —O—, —$NR^{10}$—, —$NR^{10}$—$C_1$-$C_6$ alkylene-, —O—$NR^{10}$—, —$NR^{10}$—$C_1$-$C_6$ alkylene-(O—$C_1$-$C_6$ alkylene)$_n$-, —$NR^{10}$-$L^4$-, —$NR^{10}$—$C_1$-$C_6$ alkylene-$NR^{11}$—(C(=O)—$C_1$-$C_6$ alkylene-O—)$_m$—, or —$NR^{10}$—$C_1$-$C_6$ alkylene-$NR^{10}$—$C_1$-$C_6$ alkylene-$NR^{10}$—$C_1$-$C_6$ alkylene-;
- $L^4$ is a bond, -heterocyclyl-, or -heterocyclyl-$C_1$-$C_6$ alkylene-;
- $R^{10}$ is hydrogen or $C_1$-$C_6$ alkyl;
- $R^{11}$ is hydrogen or $C_1$-$C_6$ alkyl;
- $R^{12}$ and $R^{13}$ are independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring;
- $R^{14}$ is hydrogen or $C_1$-$C_6$ alkylene, -($L^5$)-aryl, -($L^5$)-heteroaryl, —$NR^{17}R^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;
- $L^5$ is a bond, $C_1$-$C_{10}$ alkylene, —O—, —$NR^{10}$—;
- $R^{17}$ and $R^{18}$ are each independently hydrogen or aryl;
- $R^{19}$ and $R^{20}$ are independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;
- n is 0, 1, 2, or 3;
- m is 0, 1, 2, or 3;
- p is 0, 1, 2, or 3;
- q is 0, 1, 2, or 3; and
- $A^4$ is a polypeptide having at least 85% sequence identity with MCMPCFTTDHQMARRCDDCCGGR-GRGKCYGPQCLCR or a fragment thereof.

In other aspects, compounds of the present disclosure have a structure of Formula (IV), or a pharmaceutically acceptable salt thereof:

(IV)

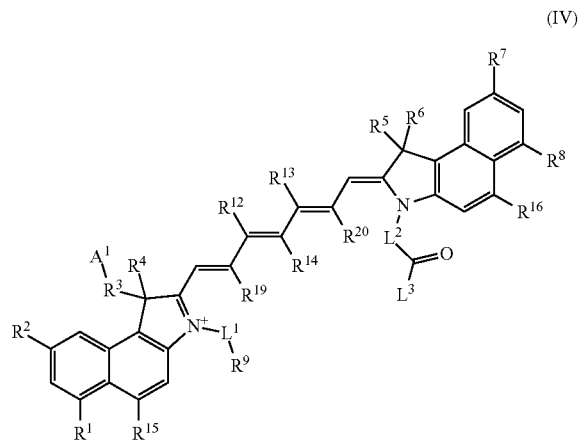

wherein:
- $R^1$, $R^2$, $R^4$, $R^5$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —$SO_2$—$NH_2$, or $C_1$-$C_6$ alkoxy;
- $R^3$ is selected from $C_1$-$C_{10}$ alkylene-(C(=O))$_x$—, $C_1$-$C_{10}$ alkylene-(C(=O))$_x$—O—, or $C_1$-$C_{10}$ alkylene-(C(=O))$_x$—$NR^{10}$—;
- $R^9$ is hydrogen, sulfonate, or —COOH, or $C_1$-$C_{10}$ alkyl;
- $L^1$ is $C_3$-$C_6$ alkylene;
- $L^2$ is $C_1$-$C_{10}$ alkylene;
- $L^3$ is hydrogen, sulfonate, —COOH, $C_1$-$C_{10}$ alkyl;
- $L^4$ is a bond, -heterocyclyl-, or -heterocyclyl-$C_1$-$C_6$ alkylene-;
- $R^{10}$ is hydrogen or $C_1$-$C_6$ alkyl;
- $R^{11}$ is hydrogen or $C_1$-$C_6$ alkyl;
- $R^{12}$ and $R^{13}$ are independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring;
- $R^{14}$ is hydrogen or $C_1$-$C_6$ alkylene, -($L^5$)-aryl, -($L^5$)-heteroaryl, —$NR^{17}R^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;
- $L^5$ is a bond, $C_1$-$C_{10}$ alkylene, —O—, —$NR^{10}$—;
- $R^7$ and $R^{18}$ are each independently hydrogen or aryl;
- $R^{19}$ and $R^{20}$ are independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;

n is 0, 1, 2, or 3;
m is 0, 1, 2, or 3;
p is 0, 1, 2, or 3;
q is 0, 1, 2, or 3;
x is 0 or 1; and
$A^1$ is a polypeptide having at least 85% sequence identity with MCMPCFTTDHQMARRCDDCCGGR-GRGKCYGPQCLCR or a fragment thereof.

In other aspects, compounds of the present disclosure have a structure of Formula (V), or a pharmaceutically acceptable salt thereof:

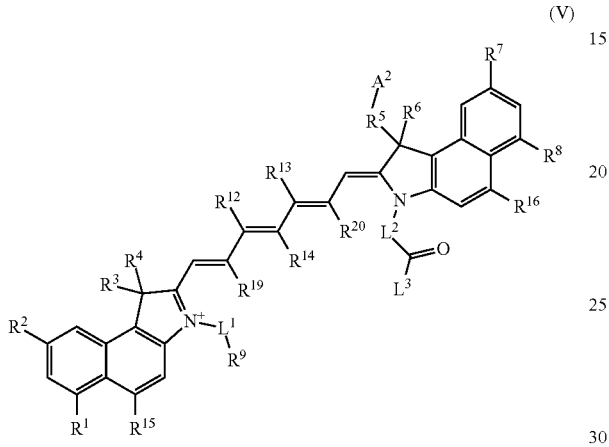

(V)

wherein:
$R^1$, $R^2$, $R^3$, $R^4$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —$SO_2$—$NH_2$, or $C_1$-$C_6$ alkoxy;
$R^5$ is selected from $C_1$-$C_{10}$ alkylene-(C(=O))$_x$—, $C_1$-$C_{10}$ alkylene-(C(=O))$_x$—O—, or $C_1$-$C_{10}$ alkylene-(C(=O))$_x$—$NR^{10}$—;
$R^9$ is hydrogen, sulfonate, or —COOH, or $C_1$-$C_{10}$ alkyl;
$L^1$ is $C_3$-$C_6$ alkylene;
$L^2$ is $C_1$-$C_{10}$ alkylene;
$L^3$ is hydrogen, sulfonate, —COOH, or $C_1$-$C_{10}$ alkyl;
$L^4$ is a bond, -heterocyclyl-, or -heterocyclyl-$C_1$-$C_6$ alkylene-;
$R^{10}$ is hydrogen or $C_1$-$C_6$ alkyl;
$R^{11}$ is hydrogen or $C_1$-$C_6$ alkyl;
$R^{12}$ and $R^{13}$ are independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring;
$R^{14}$ is hydrogen or $C_1$-$C_6$ alkylene, -($L^5$)-aryl, -($L^5$)-heteroaryl, —$NR^{17}R^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;
$L^5$ is a bond, $C_1$-$C_{10}$ alkylene, —O—, —$NR^{10}$—;
$R^{17}$ and $R^{18}$ are each independently hydrogen or aryl;
$R^{19}$ and $R^{20}$ are independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;
n is 0, 1, 2, or 3;
m is 0, 1, 2, or 3;
p is 0, 1, 2, or 3;
q is 0, 1, 2, or 3;
x is 0 or 1; and
$A^2$ is a polypeptide having at least 85% sequence identity with MCMPCFTTDHQMARRCDDCCGGR-GRGKCYGPQCLCR or a fragment thereof.

In some aspects, compounds of the present disclosure have a structure of Formula (VI), or a pharmaceutically acceptable salt thereof:

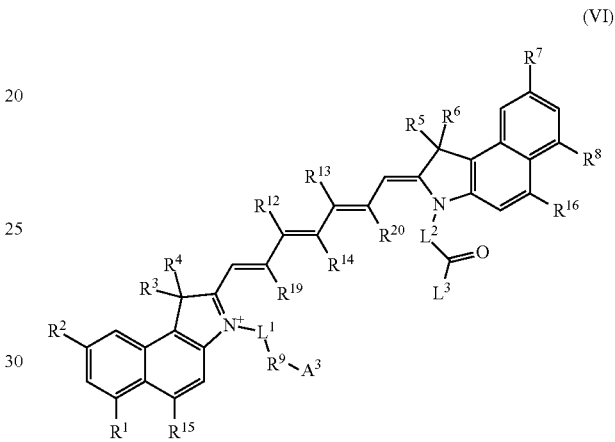

(VI)

wherein:
$R^1$, $R^2$, $R^3$, $R^4$, $R^5$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —$SO_2$—$NH_2$, or $C_1$-$C_6$ alkoxy;
$R^9$ is selected from $C_1$-$C_{10}$ alkylene-(C(=O))$_x$—, $C_1$-$C_{10}$ alkylene-(C(=O))$_x$—O—, or $C_1$-$C_{10}$ alkylene-(C(=O))$_x$—$NR^{10}$—;
$L^1$ is $C_3$-$C_6$ alkylene;
$L^2$ is $C_1$-$C_{10}$ alkylene;
$L^3$ is hydrogen, sulfonate, —COOH, or $C_1$-$C_{10}$ alkyl;
$L^4$ is a bond, -heterocyclyl-, or -heterocyclyl-$C_1$-$C_6$ alkylene-;
$R^{10}$ is hydrogen or $C_1$-$C_6$ alkyl;
$R^{11}$ is hydrogen or $C_1$-$C_6$ alkyl;
$R^{12}$ and $R^{13}$ are independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring;
$R^{14}$ is hydrogen or $C_1$-$C_6$ alkylene, -($L^5$)-aryl, -($L^5$)-heteroaryl, —$NR^{17}R^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;
$R^7$ and $R^{18}$ are each independently hydrogen or aryl;
$R^{19}$ and $R^{20}$ are independently selected from hydrogen, $C_1$-$C_6$ alkyl, $R^{14}$ and $R^{19}$ are joined together along with the other atoms to which they are attached to form a 5-membered or 6-membered carbocyclic ring, or $R^{14}$ and $R^{20}$ are joined together along with the other atoms to which they are attached to form a 5-membered or 6-membered carbocyclic or heterocyclic ring;

n is 0, 1, 2, or 3;
m is 0, 1, 2, or 3;
p is 0, 1, 2, or 3;
q is 0, 1, 2, or 3;
x is 0 or 1;
$L^5$ is a bond, $C_1$-$C_{10}$ alkylene, —O—, —$NR^{10}$—;
$A^3$ is a polypeptide having at least 85% sequence identity with MCMPCFTTDHQMARRCDDCCGGR-GRGKCYGPQCLCR or a fragment thereof.

In additional aspects, compounds of the present disclosure have a structure Formula (III), or a pharmaceutically acceptable salt thereof:

(III)

wherein:
$R^1$, $R^2$, $R^3$, $R^4$, $R^5$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —$SO_2$—$NH_2$, or $C_1$-$C_6$ alkoxy;
$R^9$ is hydrogen, sulfonate, or —COOH;
$L^1$ is $C_3$-$C_6$ alkylene;
$L^2$ is $C_1$-$C_{10}$ alkylene;
$L^3$ is a bond, —O—, —$NR^{10}$—, —$NR^{10}$—$C_1$-$C_6$ alkylene-, —O—$NR^{10}$—, —$NR^{10}$—$C_1$-$C_6$ alkylene-(O—$C_1$-$C_6$ alkylene)$_n$-, —$NR^{10}$-$L^4$-, —$NR^{10}$—$C_1$-$C_6$ alkylene-$NR^{11}$—(C(=O)—$C_1$-$C_6$ alkylene-O—)$_m$—, or —$NR^{10}$—$C_1$-$C_6$ alkylene $NR^{10}$—$C_1$-$C_6$ alkylene $NR^{10}$—$C_1$-$C_6$ alkylene-;
$L^4$ is a bond, -heterocyclyl-, or -heterocyclyl-$C_1$-$C_6$ alkylene-;
$R^{10}$ is hydrogen or $C_1$-$C_6$ alkyl;
$R^{11}$ is hydrogen or $C_1$-$C_6$ alkyl;
$R^{12}$ and $R^{13}$ are independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring;
$R^{14}$ is -($L^5$)-aryl-$A^5$, or -($L^5$)-heteroaryl-$A^5$;
$L^5$ is a bond, $C_1$-$C_{10}$ alkylene, —O—, —$NR^{10}$—;
$R^{17}$ and $R^{18}$ are each independently hydrogen or aryl;
$R^{19}$ and $R^{20}$ are independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring;
n is 0, 1, 2, or 3;
m is 0, 1, 2, or 3;
p is 0, 1, 2, or 3;
q is 0, 1, 2, or 3;
x is 0 or 1;
$A^4$ is hydrogen, —COOH, or sulfonate; and
$A^5$ is a polypeptide having at least 85% sequence identity with MCMPCFTTDHQMARRCDDCCGGR-GRGKCYGPQCLCR or a fragment thereof.

In certain aspects, $A^1$, $A^2$, and $A^3$ are absent. In some aspects, $A^5$ is hydrogen. In certain aspects, $R^3$, $R^4$, $R^5$, and $R^6$ are each independently $C_1$-$C_6$ alkyl. In some aspects, $R^3$, $R^4$, $R^5$, $R^6$ are each independently methyl. In certain aspects, $R^1$, $R^2$, $R^7$, $R^8$, $R^{15}$, and $R^{16}$ are each independently selected from hydrogen or sulfonate. In further aspects, $R^1$, $R^2$, $R^7$, $R^8$, $R^{15}$, and $R^{16}$ are each independently hydrogen. In some aspects, $R^{12}$, $R^{13}$, $R^{14}$, $R^{19}$, $R^{20}$ are each independently hydrogen.

In certain aspects, $R^{12}$ and $R^{13}$ join together along with the atoms to which they are attached to form a six-membered carbocyclic ring. In other aspects, $R^{12}$ and $R^{13}$ join together along with the atoms to which they are attached to form a five-membered carbocyclic ring. In certain aspects, $R^{14}$ and $R^{19}$ join together along with the atoms to which they are attached to form a six-membered carbocyclic ring. In some aspects, $R^{14}$ and $R^{20}$ join together along with the atoms to which they are attached to form a six-membered carbocyclic ring. In certain aspects, $L^1$ is $C_3$-$C_6$ alkylene. In other aspects, $L^1$ is $C_3$-$C_5$ alkylene. In still other aspects, $L^1$ is propylene. In still other aspects, $L^1$ is butylene. In other aspects, $L^1$ is pentylene. In some aspects, $L^2$ is $C_3$-$C_6$ alkylene. In other aspects, $L^2$ is propylene. In still other aspects, $L^2$ is butylene. In other aspects, $L^2$ is pentylene. In some aspects, $R^9$ is sulfonate. In other aspects, $R^9$ is hydrogen. In some aspects, $R^{14}$ is hydrogen. In other aspects, $R^{14}$ is -($L^5$)-aryl. In still other aspects, $R^{14}$ is -($L^5$)-aryl-$A^5$.

In some aspects, $R^1$ is hydrogen. In certain aspects, $R^2$ is hydrogen. In some aspects, $R^3$ is methyl. In certain aspects, $R^4$ is methyl. In some aspects, $R^5$ is methyl. In certain aspects $R^6$ is methyl. In some aspects, $R^7$ is hydrogen. In certain aspects, $R^8$ is hydrogen. In some aspects, $R^{12}$ is hydrogen. In certain aspects, $R^{13}$ is hydrogen. In some aspects, $R^{14}$ is hydrogen. In certain aspects, $R^{19}$ is hydrogen. In some aspects, $R^{20}$ is hydrogen. In certain aspects, $R^{10}$ is hydrogen. In some aspects, $R^{11}$ is hydrogen.

In some aspects, $R^{17}$ and $R^{18}$ are independently phenyl. In some aspects, $L^3$ is selected from a bond, —O—, —$NR^{10}$—, —$NR^{10}$—$C_1$-$C_6$ alkylene-, —O—$NR^{10}$—, or —$NR^{10}$-$L^4$-. In further aspects, $L^3$ is a bond.

In some aspects, $L^4$ is -heterocyclyl- or -heterocyclyl-$C_1$-$C_6$ alkylene-. In further aspects, $L^4$ is -piperizinyl-($C_1$-$C_6$ alkylene)-. In still further aspects, $L^4$ is In some aspects, p is 1. In certain aspects, q is 1.

In some aspects, the compound has the structure of any one of Formulas (VII), (VIII), (IX), (X), (XI), (XII), (XIII), or (XIV):
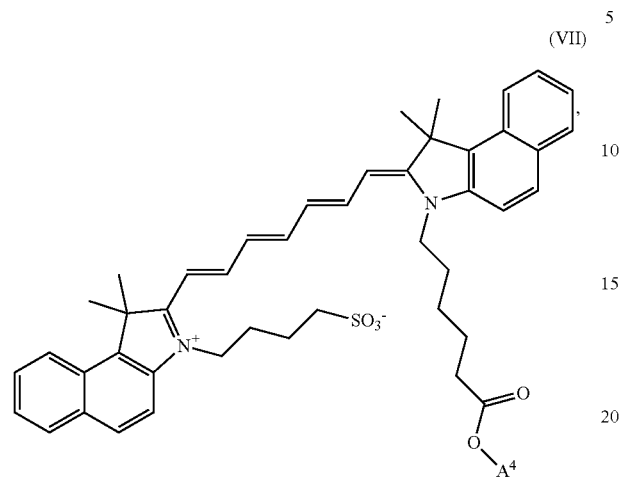
(VII)
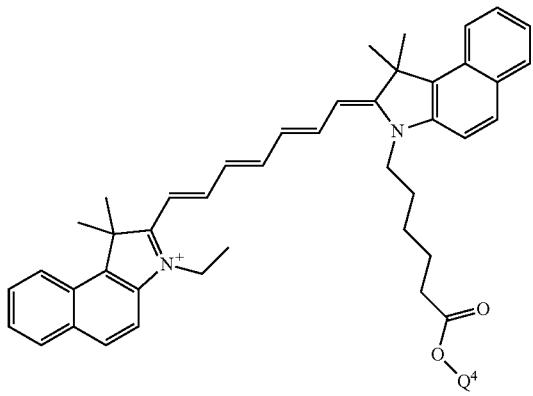
(X)
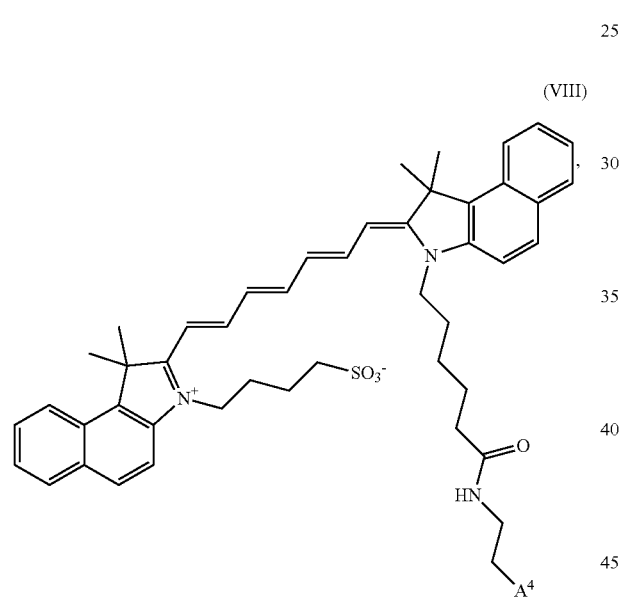
(VIII)
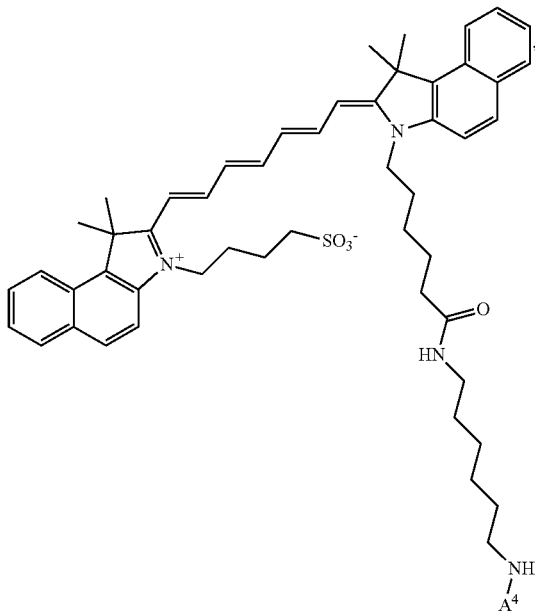
(XI)
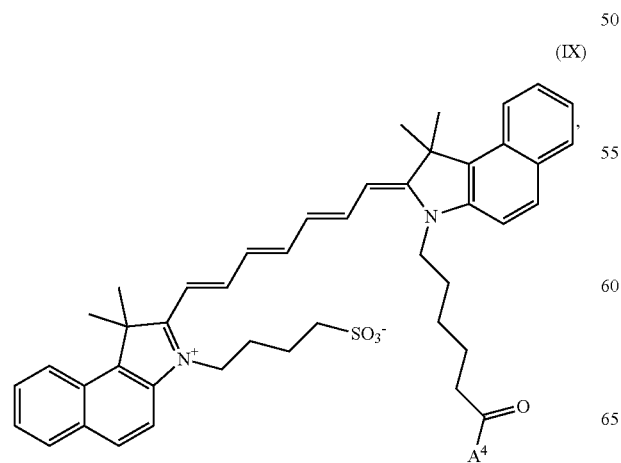
(IX)
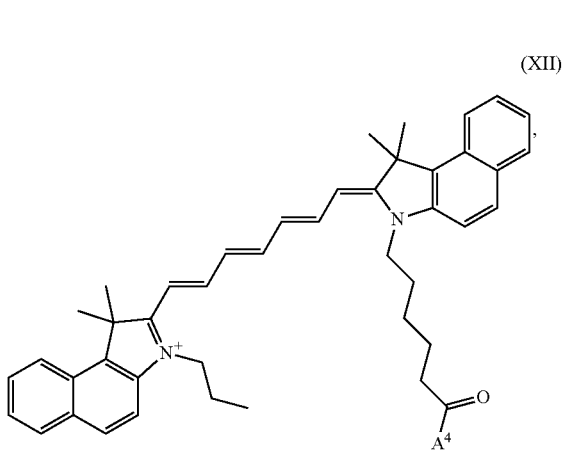
(XII)

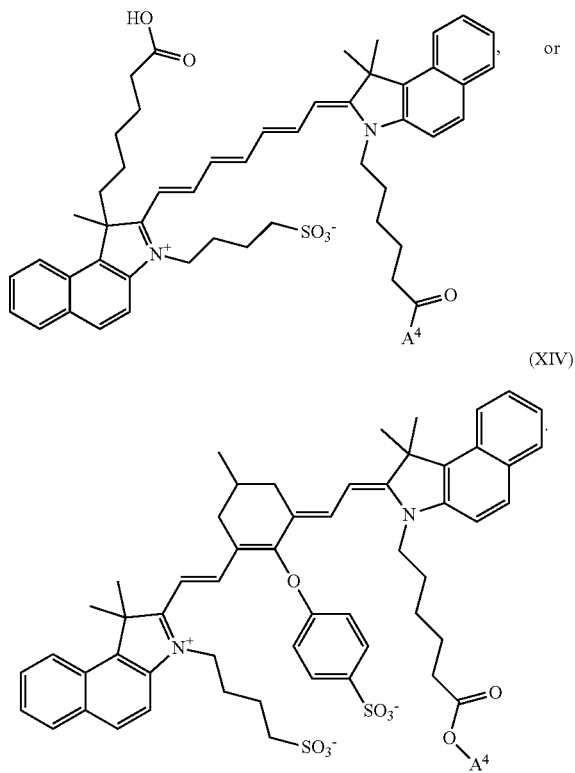

In some aspects, one of $A^1$, $A^2$, $A^3$, $A^4$, or $A^5$ is a polypeptide having at least 87% sequence identity with MCMPCFTTDHQMARRCDDCCGGR-GRGKCYGPQCLCR or a fragment thereof. In further aspects, one of $A^1$, $A^2$, $A^3$, $A^4$, or $A^5$ is a polypeptide having at least 90% sequence identity with MCMPCFTTDHQMARRCDDCCGGR-GRGKCYGPQCLCR or a fragment thereof. In still further aspects, one of $A^1$, $A^2$, $A^3$, $A^4$, or $A^5$ is a polypeptide having at least 92% sequence identity with MCMPCFTTDHQMARRCDDCCGGR-GRGKCYGPQCLCR or a fragment thereof. In still further aspects, one of $A^1$, $A^2$, $A^3$, $A^4$, or $A^5$ is a polypeptide having at least 95% sequence identity with MCMPCFTTDHQMARRCDDCCGGR-GRGKCYGPQCLCR or a fragment thereof. In still further aspects, one of $A^1$, $A^2$, $A^3$, $A^4$, or $A^5$ is a polypeptide having at least 97% sequence identity with MCMPCFTTDHQMARRCDDCCGGR-GRGKCYGPQCLCR or a fragment thereof. In still further aspects, one of $A^1$, $A^2$, $A^3$, $A^4$, or $A^5$ is a polypeptide having 100% sequence identity with MCMPCFTTDHQMARRCDDCCGGR-GRGKCYGPQCLCR or a fragment thereof. In still further aspects, one of $A^1$, $A^2$, $A^3$, $A^4$, or $A^5$ is a polypeptide having the sequence MCMPCFTTDHQMARRCDDCCGGR-GRGKCYGPQCLCR or a fragment thereof.

In some aspects, the fragment of $A^1$, $A^2$, $A^3$, $A^4$, or $A^5$ has a length of at least 25 amino acid residues. In further aspects, the fragment of $A^1$, $A^2$, $A^3$, $A^4$, or $A^5$ has a length of at least 27 amino acid residues. In still further aspects, the fragment of $A^1$, $A^2$, $A^3$, $A^4$, or $A^5$ has a length of at least 29 amino acid residues. In still further aspects, the fragment of $A^1$, $A^2$, $A^3$, $A^4$, or $A^5$ has a length of at least 31 amino acid residues. In still further aspects, the fragment of $A^1$, $A^2$, $A^3$, $A^4$, or $A^5$ has a length of at least 33 amino acid residues.

In some aspects, one of $A^1$, $A^2$, $A^3$, $A^4$, or $A^5$ is a polypeptide having at least 85% sequence identity with MCMPCFTTDHQMARRCDDCCGGR-GRGKCYGPQCLCR or a fragment thereof having the tumor cell binding affinity of native chlorotoxin. In certain aspects, one of $A^1$, $A^2$, $A^3$, $A^4$, or $A^5$ is a polypeptide having at least 85% sequence identity with MCMPCFTTDHQMARRCDDCCGGR-GRGKCYGPQCLCR or a fragment thereof having essentially the same the tumor cell binding affinity of native chlorotoxin. In some aspects, one of $A^1$, $A^2$, $A^3$, $A^4$, or $A^5$ is a polypeptide having at least 85% sequence identity with MCMPCFTTDHQMARRCDDCCGGR-GRGKCYGPQCLCR or a fragment thereof having the tumor cell binding affinity of native chlorotoxin wherein one of $A^1$, $A^2$, $A^3$, $A^4$, or $A^5$ has a sequence selected from SEQ ID NOS: 1-481.

In some aspects, the polypeptide comprises at least one lysine amino acid residue. In certain aspects, the polypeptide comprises a single lysine amino acid residue. In some aspects, the polypeptide comprises one, two, or three lysine amino acid residues. In some aspects, the polypeptide comprises a lysine residue at the position corresponding to K-27 of native chlorotoxin. In some aspects, the polypeptide comprises a lysine residue at the position corresponding to K-23 of native chlorotoxin. In some aspects, the polypeptide comprises a lysine residue at the position corresponding to K-15 of native chlorotoxin.

In some aspects, one or more of the amino acids of the polypeptide is substituted with a non-naturally occurring amino acid residue. In further aspects the non-naturally occurring amino acid residue is a citrulline amino acid residue. In still further aspects, $L^3$ is attached to $A^4$ at a citrulline amino acid residue of the polypeptide.

In some aspects, $L^3$ is attached to $A^4$ at a lysine amino acid residue of the polypeptide. In certain aspects, $L^3$ is attached to $A^4$ at the N-terminus of the polypeptide. In some aspects, $L^3$ is attached to $A^4$ at the C-terminus of the polypeptide. In some aspects, the $R^3$ is attached to $A^1$ at a lysine amino acid residue of the peptide, a citrulline amino acid residue of the polypeptide, the N-terminus of the polypeptide, or the C-terminus of the polypeptide. In some aspects, the $R^5$ is attached to $A^2$ at a lysine amino acid residue of the polypeptide, a citrulline amino acid residue of the polypeptide, the N-terminus of the polypeptide, or the C-terminus of the polypeptide. In some aspects, the $R^9$ is attached to $A^3$ at a lysine amino acid residue of the polypeptide, a citrulline amino acid residue of the polypeptide, the N-terminus of the polypeptide, or the C-terminus of the polypeptide. In some aspects, the aryl is attached to $A^5$ at a lysine amino acid residue of the polypeptide, a citrulline amino acid residue of the polypeptide, the N-terminus of the polypeptide, or the C-terminus of the polypeptide.

In some aspects, the compound has the structure of any one of compounds 1 to 721 as found in Tables 2-13.

In some aspects, the compound is conjugated to polyethylene glycol (PEG), hydroxyethyl starch, polyvinyl alcohol, a water soluble polymer, a zwitterionic water soluble polymer, a water soluble poly(amino acid), an albumin derivative, or a fatty acid.

In some aspects, the polypeptide has an isoelectric point of from 7.5 to 9.0. In some aspects, the polypeptide has an isoelectric point of from 8.0 to 9.0. In some aspects, the polypeptide has an isoelectric point of from 8.5 to 9.0. In some aspects, the polypeptide is basic and has an isoelectric point of greater than 7.5.

In some aspects, the polypeptide comprises at least eight cysteine amino acid residues. In some aspects, the polypeptide comprises eight cysteine amino acid residues. In some aspects, the polypeptide comprises four disulfide bonds. In some aspects, the polypeptide comprises from six to seven cysteine amino acid residues. In some aspects, the polypeptide comprises three disulfide bonds. In some aspects, the spacing between the cysteine amino acid residues in the polypeptide is essentially the same as in native chlorotoxin. In some aspects, the distribution of charge on the surface of the polypeptide is essentially the same as in native chlorotoxin.

In some aspects, one or more of the methionine amino acid residues is replaced with an amino acid residue selected from isoleucine, threonine, valine, leucine, serine, glycine, alanine, or a combination thereof.

In some aspects, the compound is capable of passing across the blood brain barrier. In some aspects, the compound further comprises a therapeutic agent attached to A. In further aspects, the therapeutic agent is a cytotoxic agent.

In various aspects, the present disclosure provides a composition comprising a compound comprising a polypeptide having at least 85% sequence identity with MCMPCFTTDHQMARRCDDCCGGR-GRGKCYGPQCLCR or a fragment thereof, wherein when the composition is intravenously administering to a human subject at a dose of from 1 mg to 30 mg, the composition produces in the human subject an average maximum compound blood plasma concentration (average $C_{max}$) of at least from 110 ng/mL to 240 ng/mL per each 1 mg dosage of the compound administered.

In some aspects, the compound of the composition is any suitable compound described in the present disclosure.

Certain exemplary compounds falling within the scope of these genuses are provided below in Tables 2 to 13, including both the peptide portion (indicated by A) and the detectable label portion.

TABLE 2

Exemplary compounds according to the present disclosure.
A = MCMPCFTTDHQMARRCDDCCGGRGRGKCYGPQCLCR (SEQ ID NO: 9) (attached at K-27)

No. Structure

1 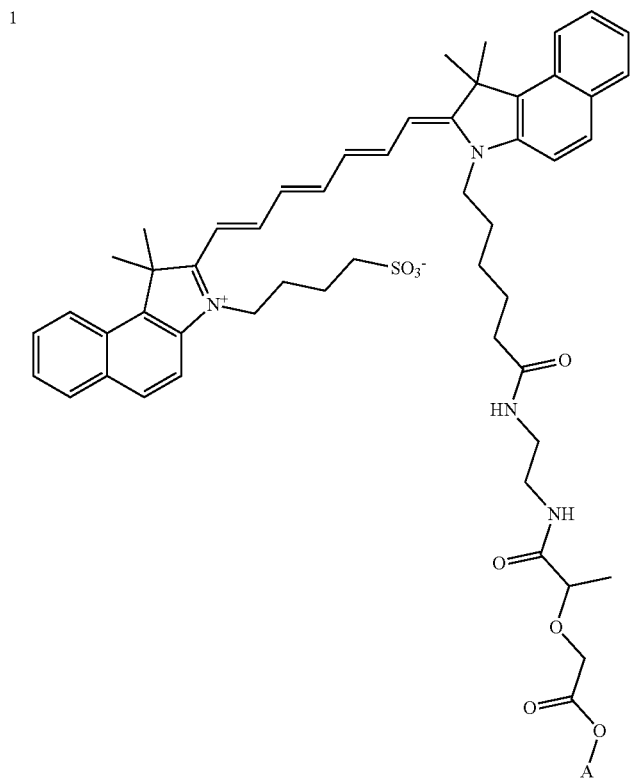

TABLE 2-continued
Exemplary compounds according to the present disclosure.
A = MCMPCFTTDHQMARRCDDCCGGRGRGKCYGPQCLCR (SEQ ID NO: 9) (attached at K-27)
| No. | Structure |
|---|---|
| 2 | 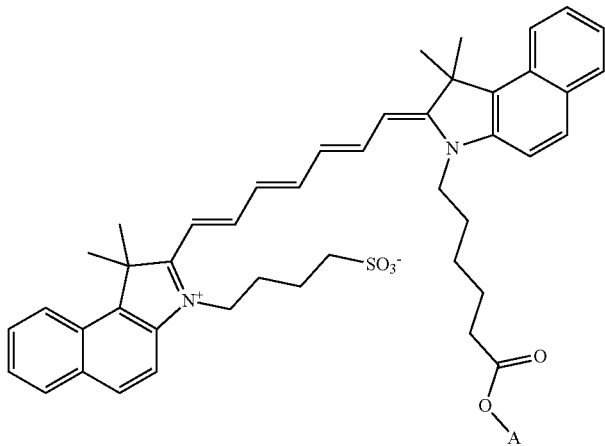 |
| 3 | 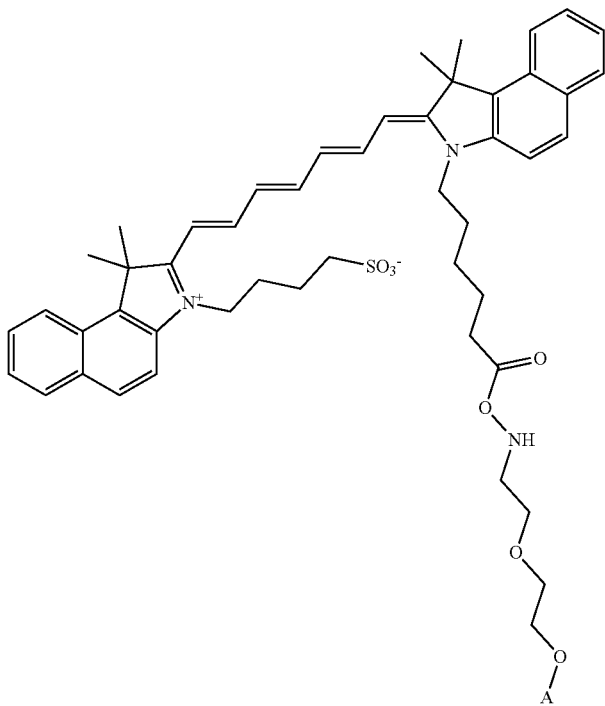 |

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
4
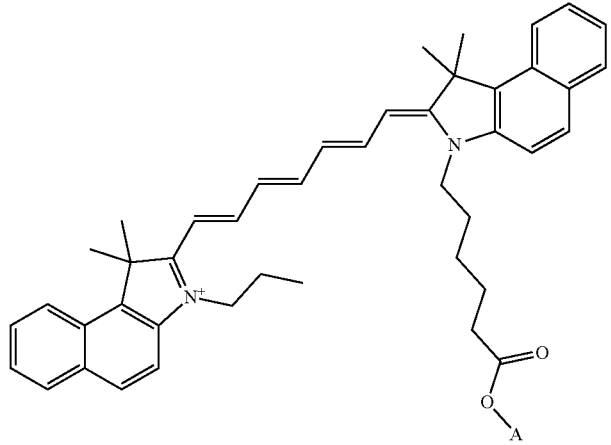
5
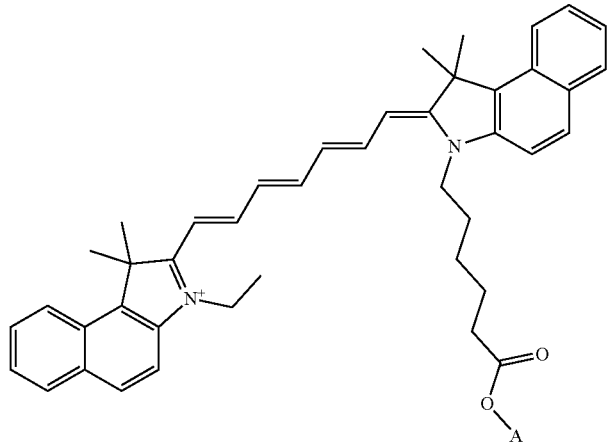
6
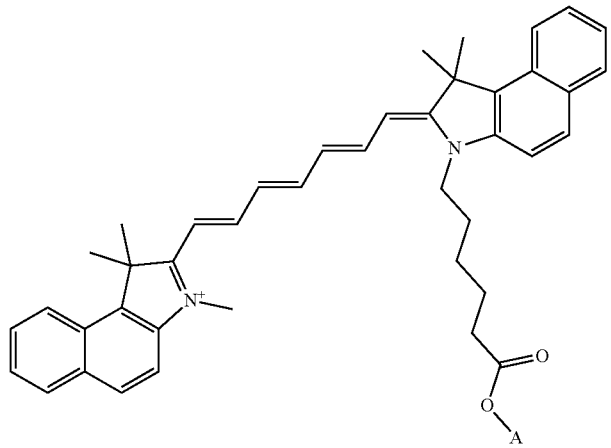

TABLE 2-continued
Exemplary compounds according to the present disclosure.
A = MCMPCFTTDHQMARRCDDCCGGRGRGKCYGPQCLCR (SEQ ID NO: 9) (attached at K-27)
| No. | Structure |
|---|---|
| 7 | 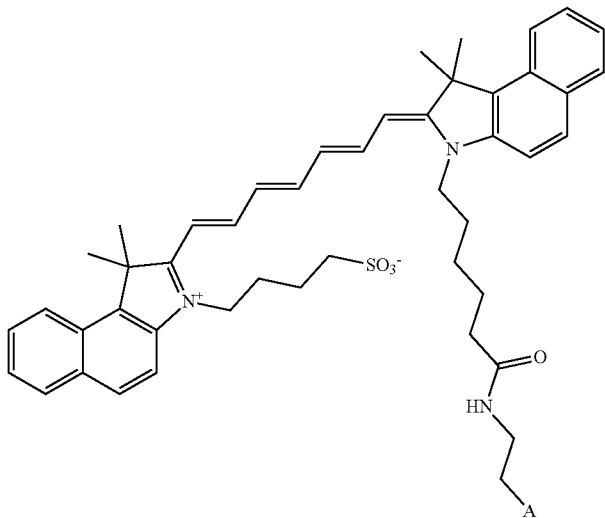 |
| 8 | 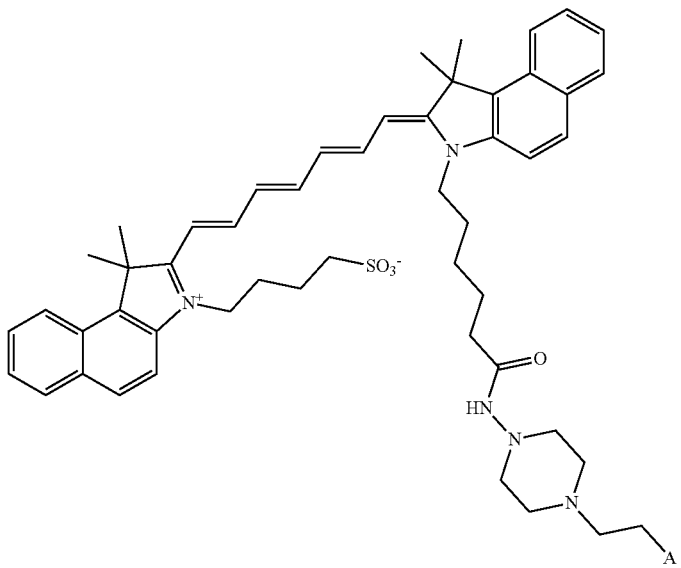 |

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
9 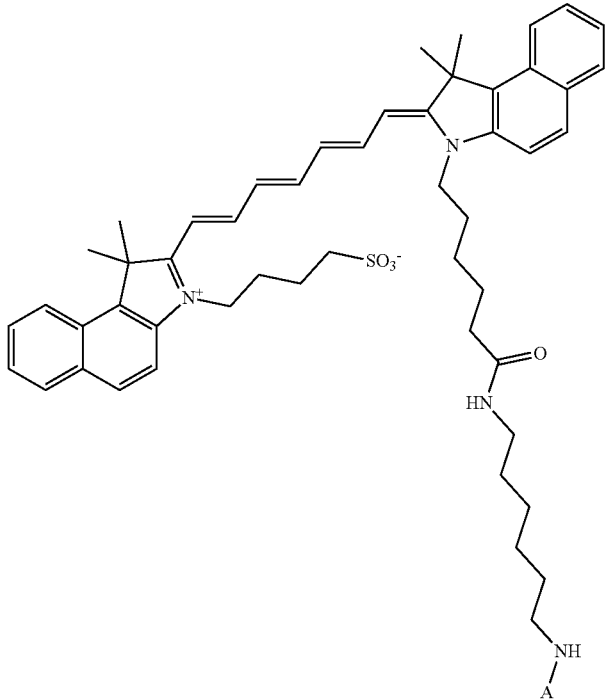
10 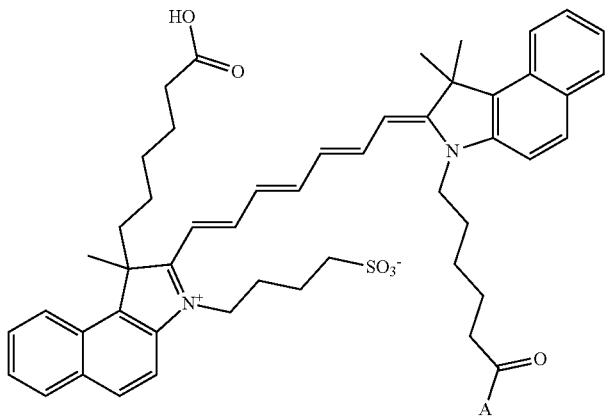

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
11
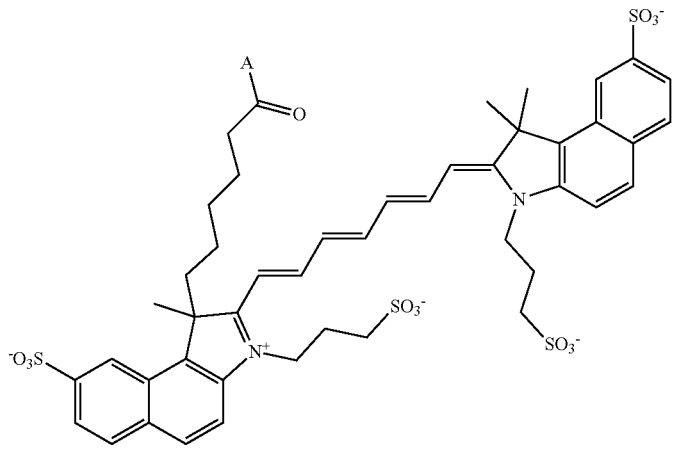
12
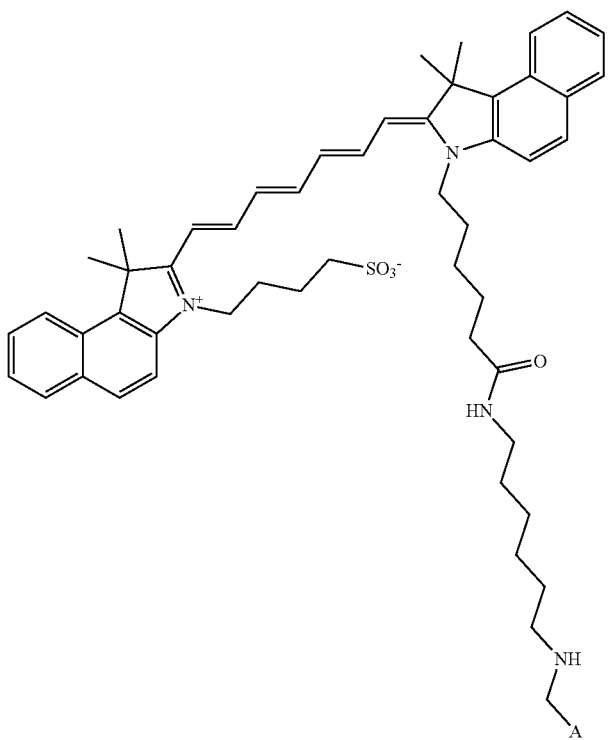

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
13
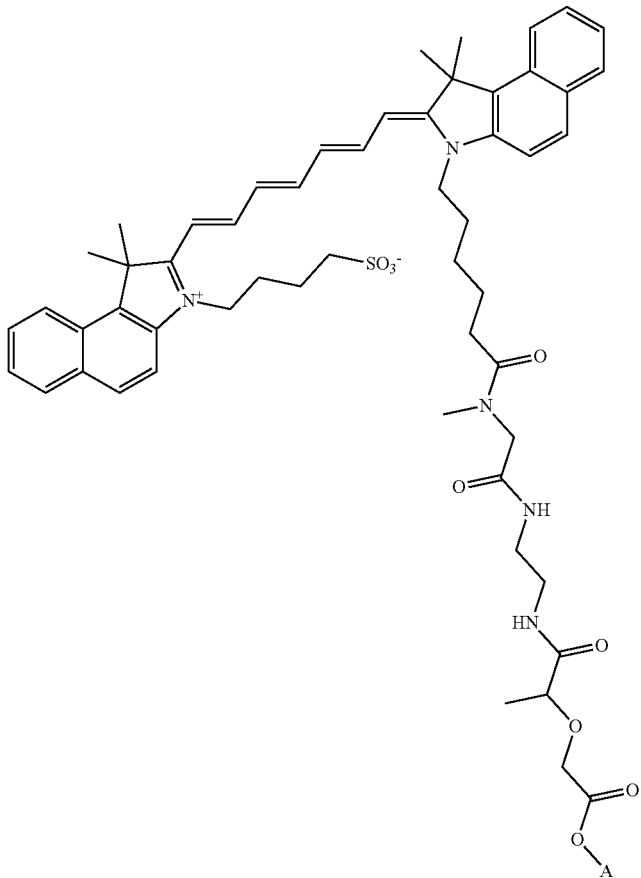
14
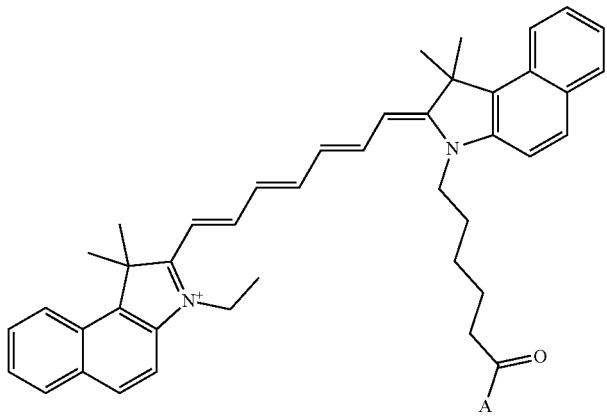

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
15
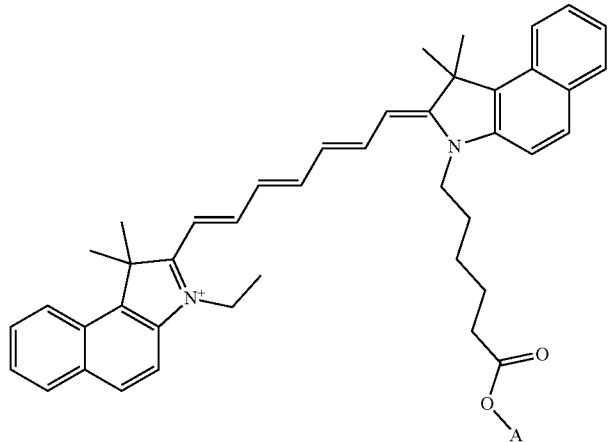
16
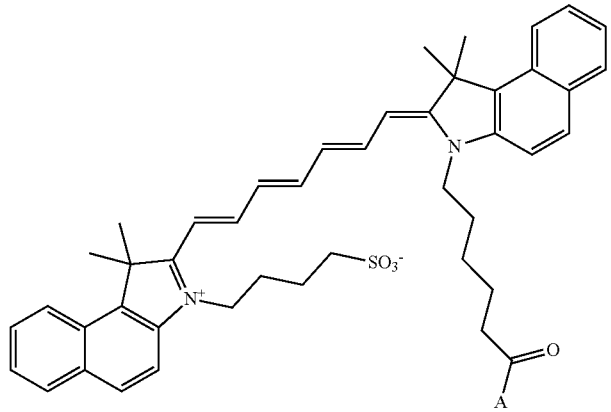
17
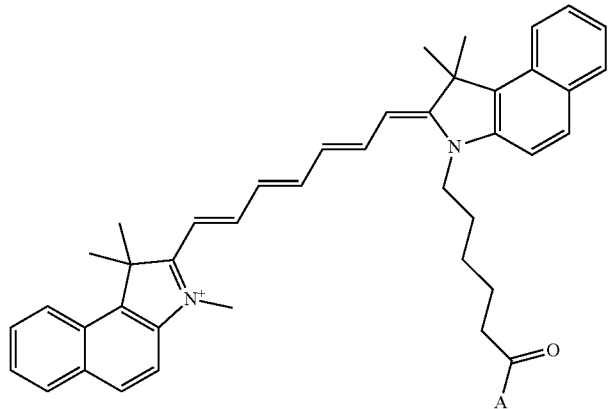

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
18
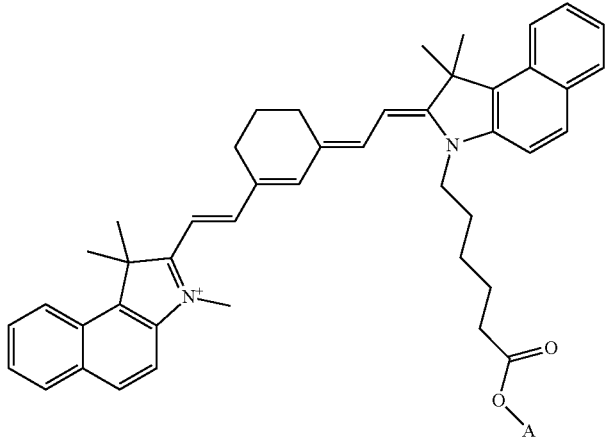
19
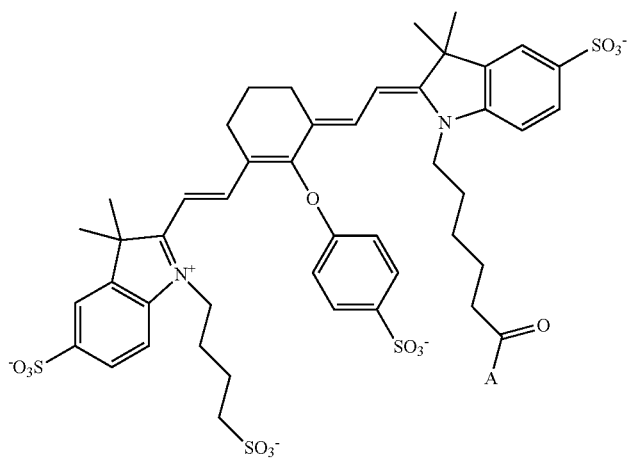
20
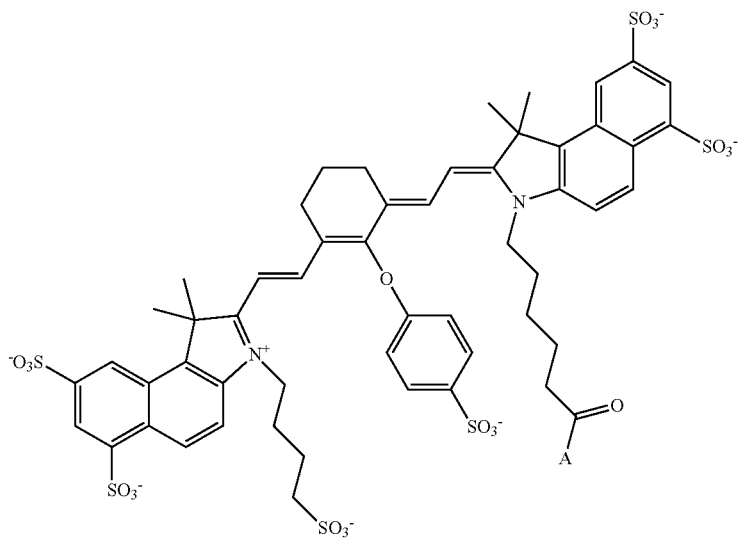

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
21
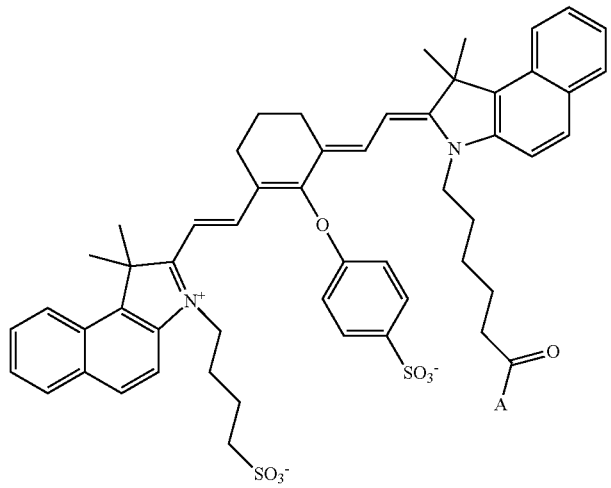
22
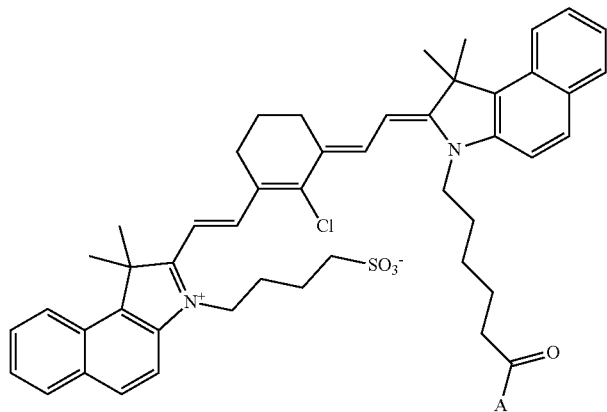
23
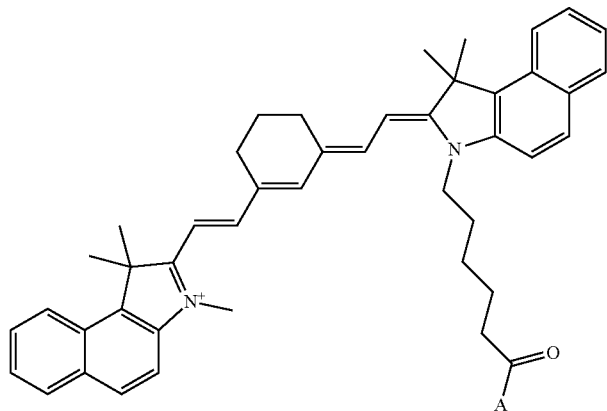

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
24
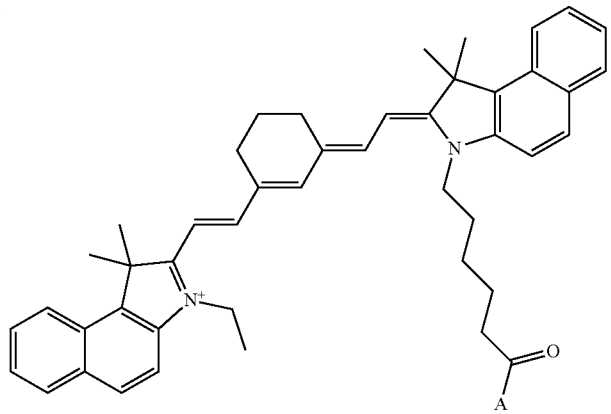
25
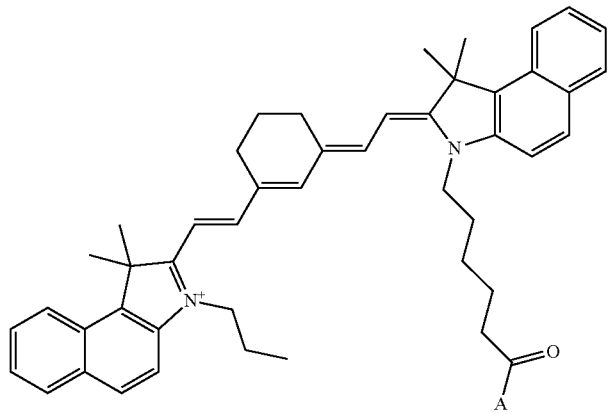
26
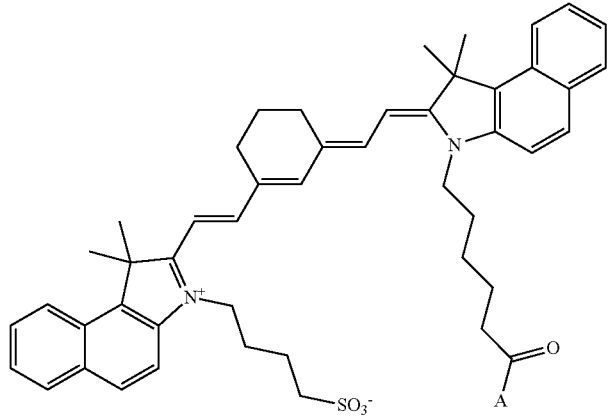

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
27
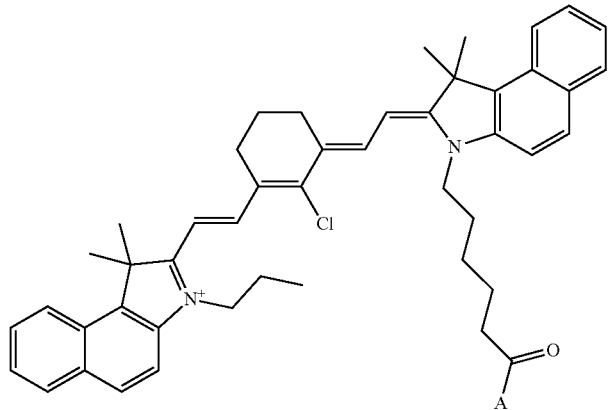
28
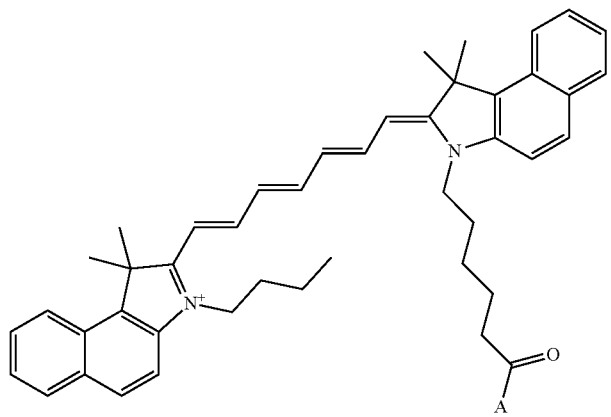

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
29
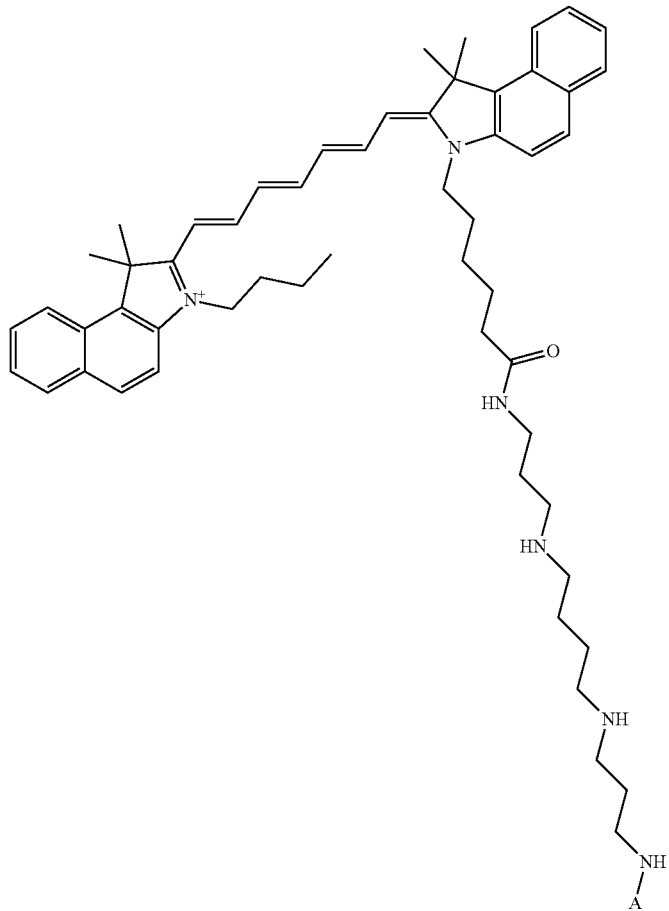
30
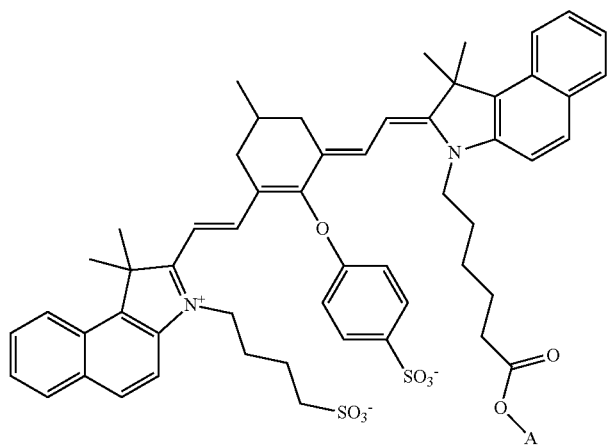

TABLE 2-continued
Exemplary compounds according to the present disclosure.
A = MCMPCFTTDHQMARRCDDCCGGRGRGKCYGPQCLCR (SEQ ID NO: 9) (attached at K-27)
| No. | Structure |
|---|---|
| 31 | 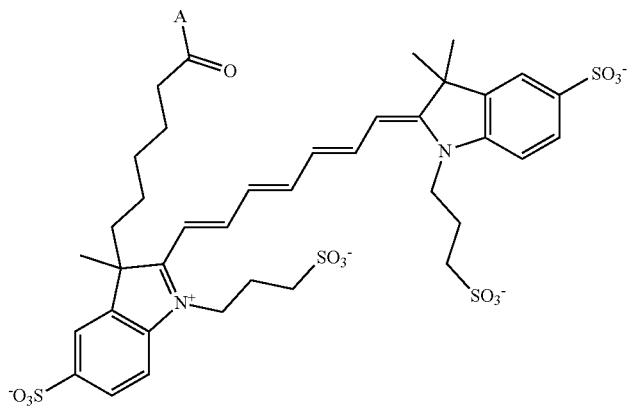 |
| 32 | 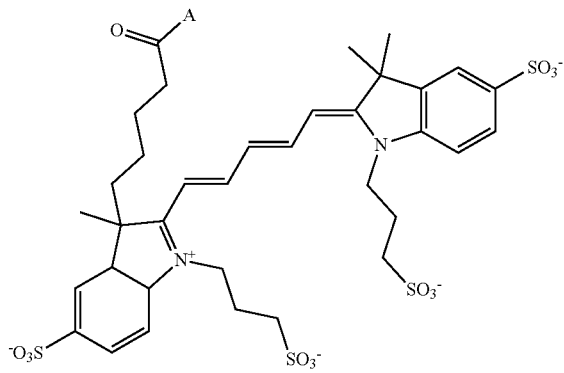 |
| 33 | 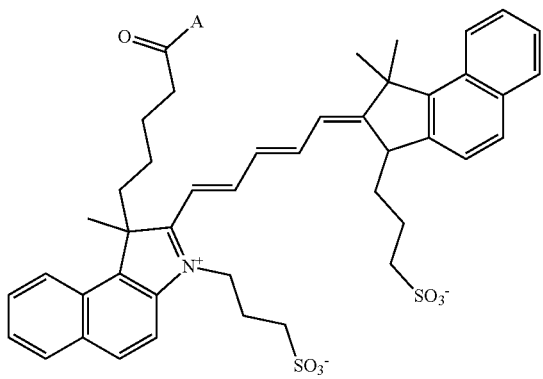 |

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
34
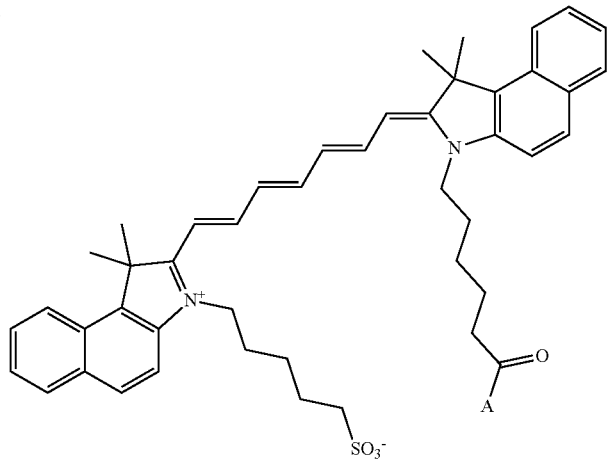
35
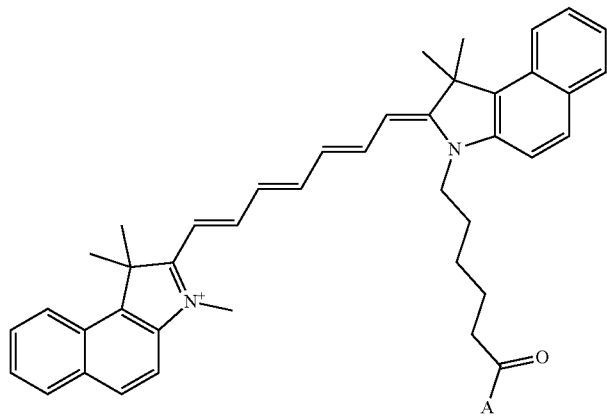
36
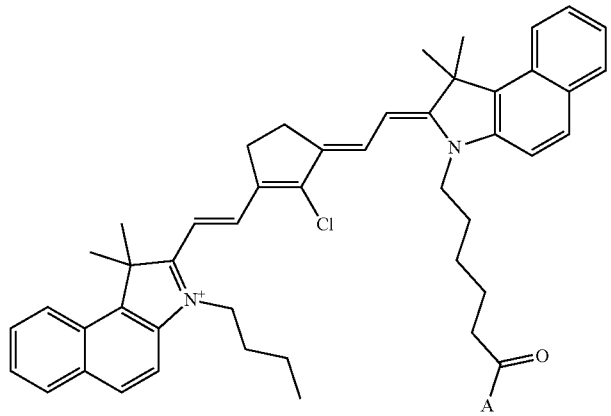

TABLE 2-continued
Exemplary compounds according to the present disclosure.
A = MCMPCFTTDHQMARRCDDCCGGRGRGKCYGPQCLCR (SEQ ID NO: 9) (attached at K-27)
| No. | Structure |
| --- | --- |
| 37 | 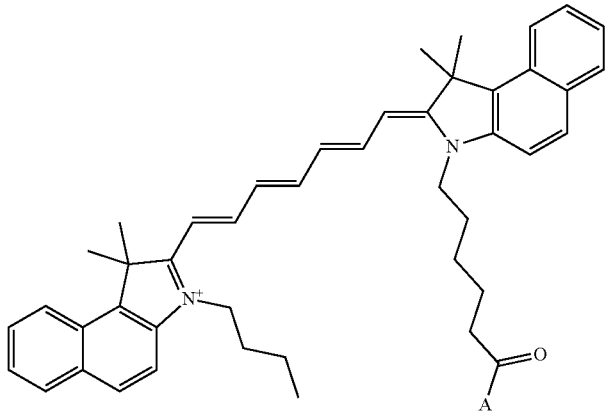 |
| 38 | 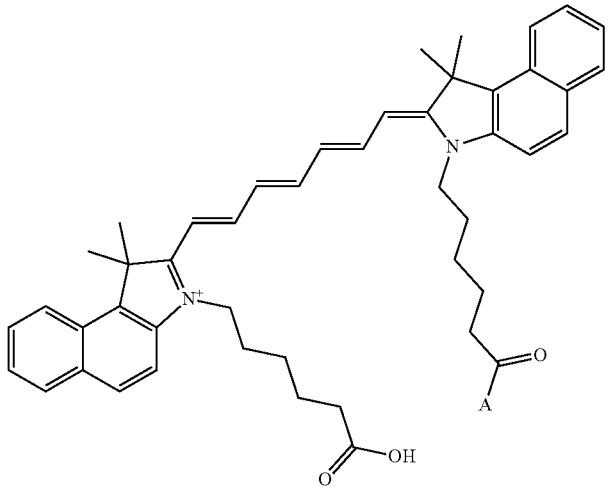 |
| 39 | 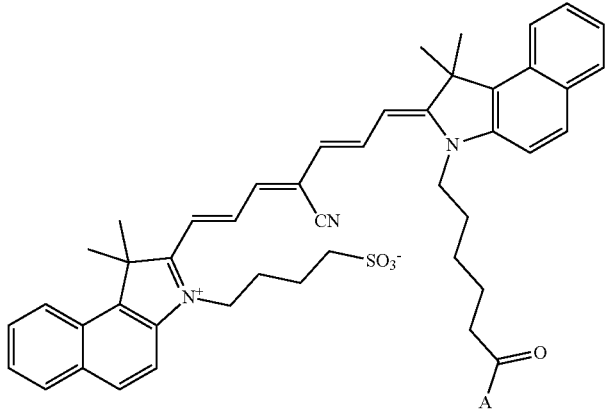 |

TABLE 2-continued
Exemplary compounds according to the present disclosure.
A = MCMPCFTTDHQMARRCDDCCGGRGRGKCYGPQCLCR (SEQ ID NO: 9) (attached at K-27)
| No. | Structure |
|---|---|
| 40 | 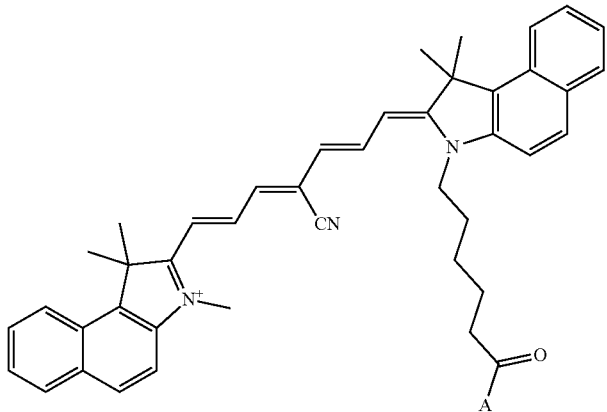 |
| 41 | 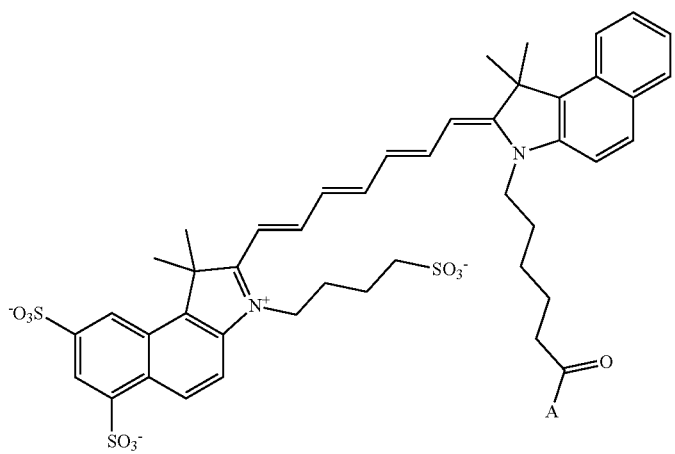 |
| 42 | 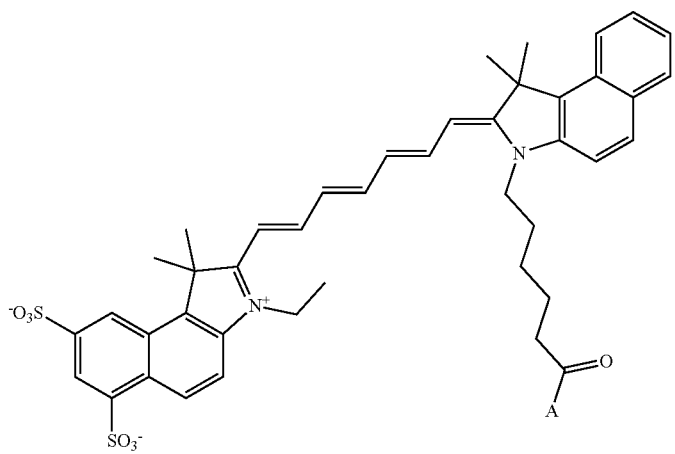 |

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
43 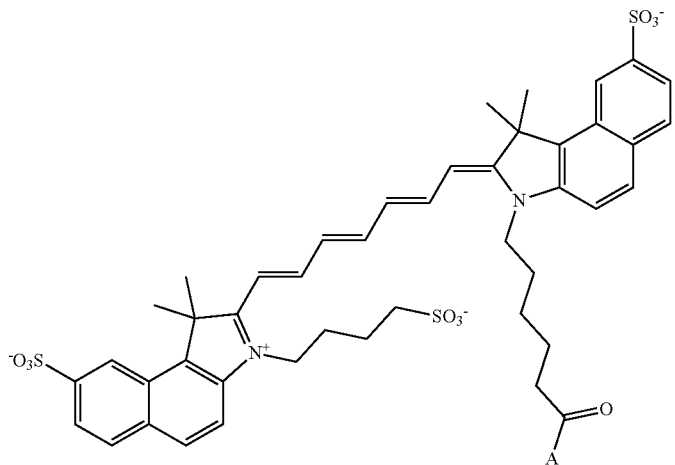
44 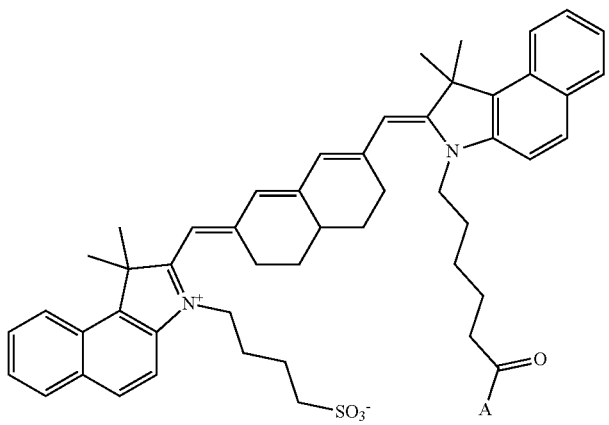
45 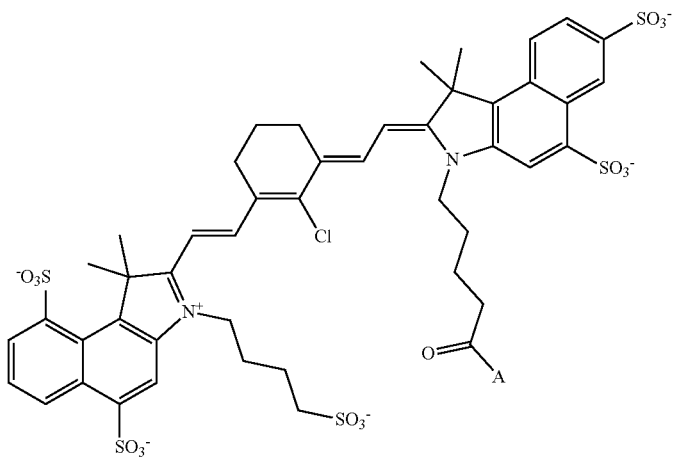

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
46
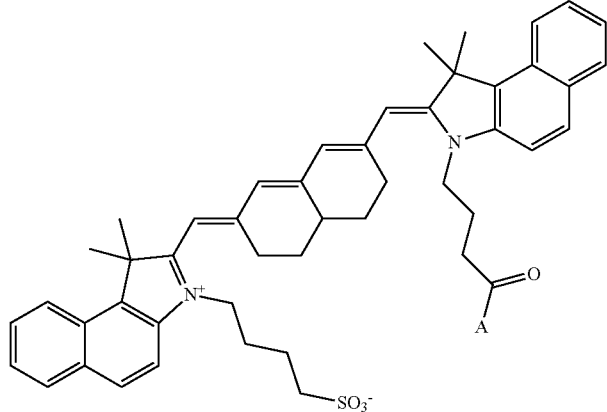
47
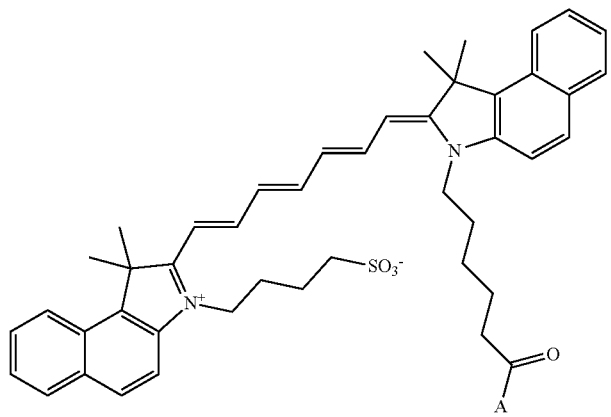
48
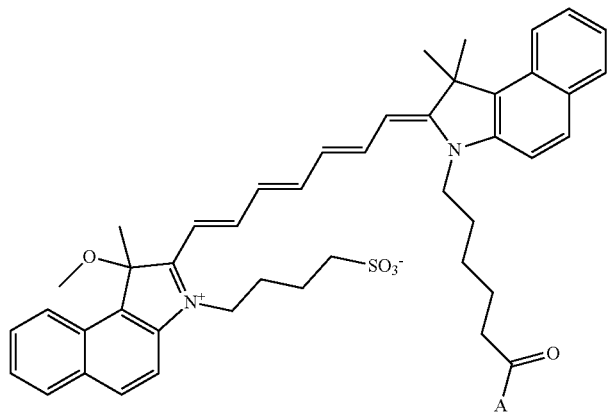

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
49
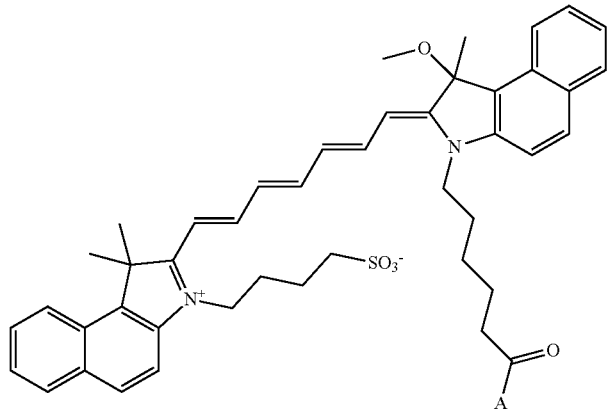
50
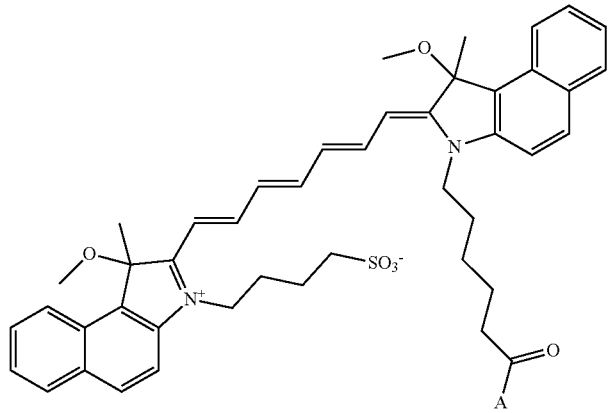
51
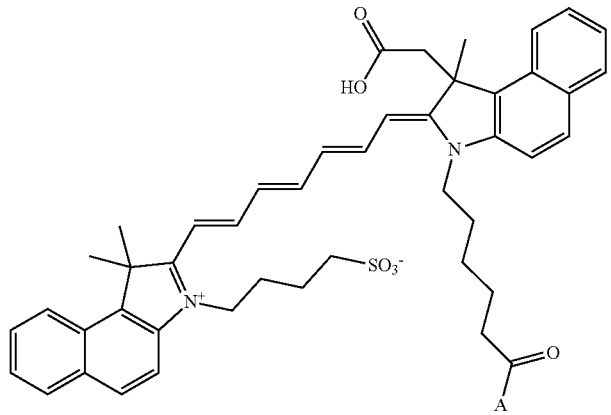

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
52
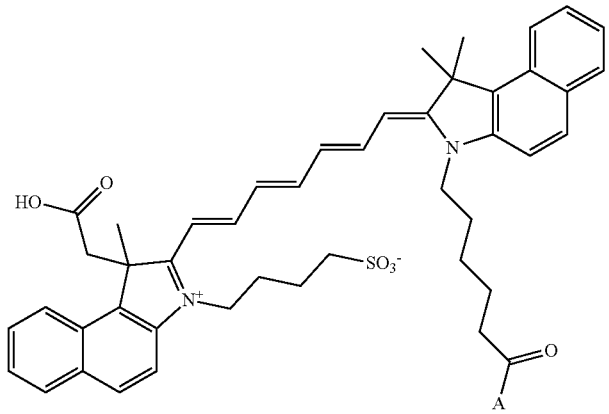
53
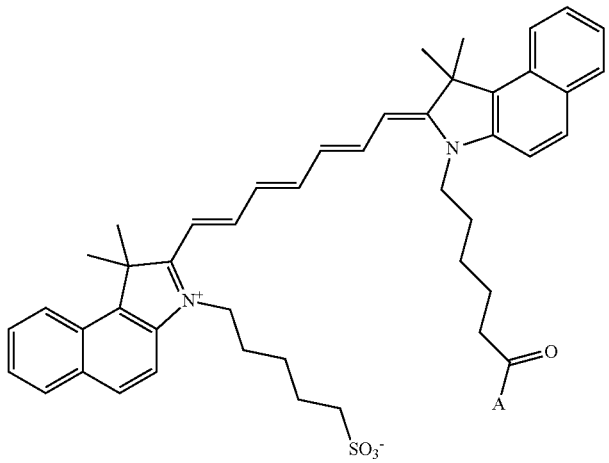
54
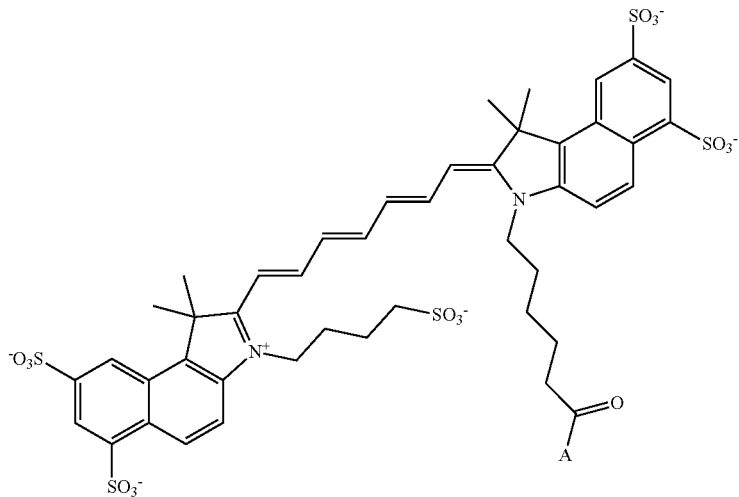

225 226
TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
55
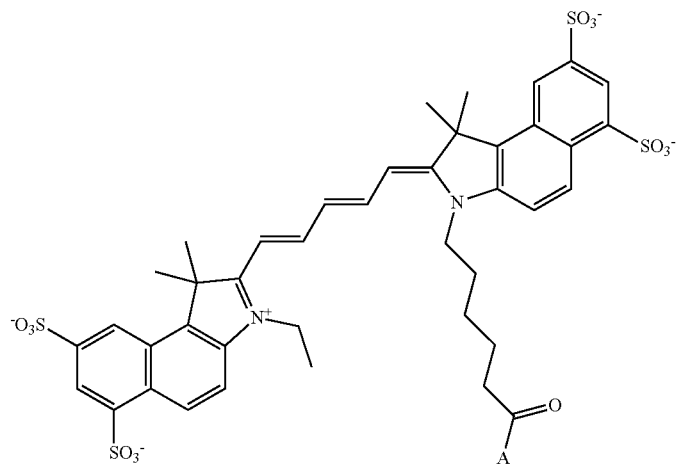
56
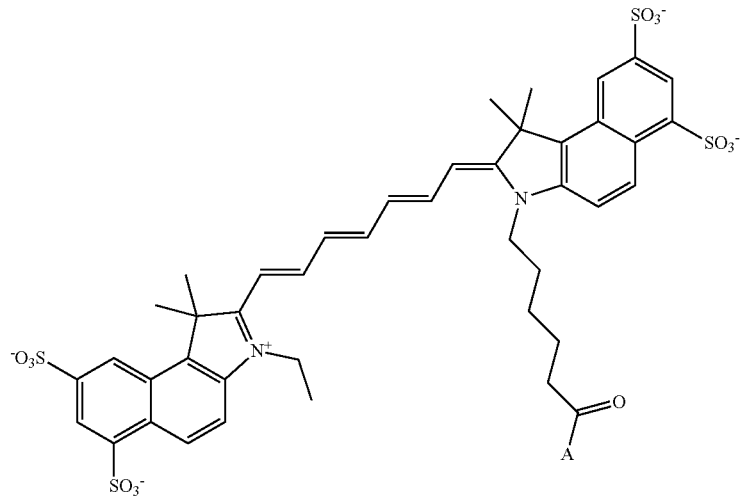
57
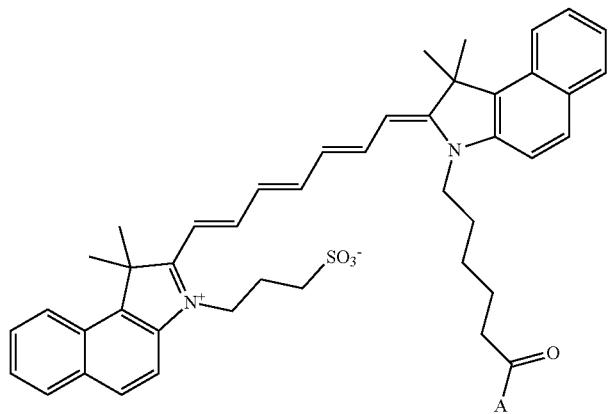

TABLE 2-continued
Exemplary compounds according to the present disclosure.
A = MCMPCFTTDHQMARRCDDCCGGRGRGKCYGPQCLCR (SEQ ID NO: 9) (attached at K-27)
No. Structure
58
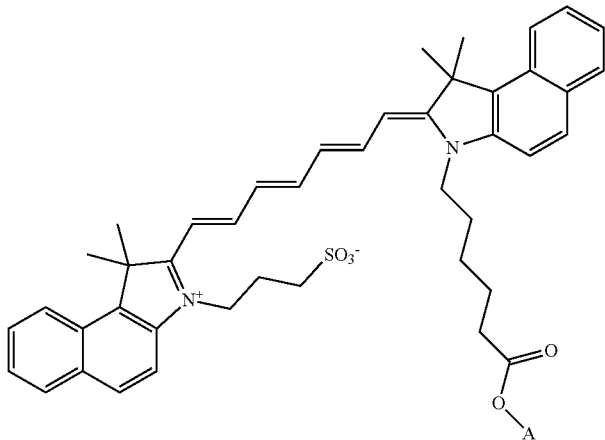
59
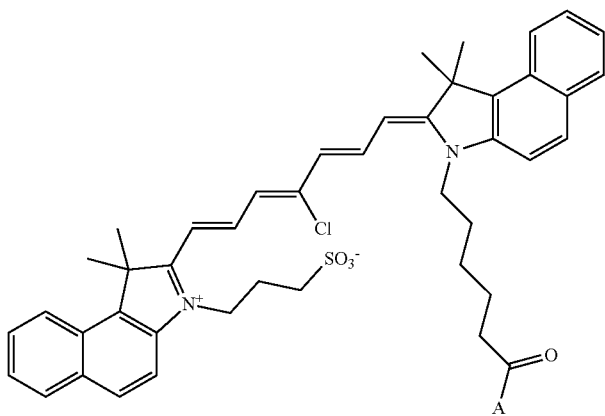
60
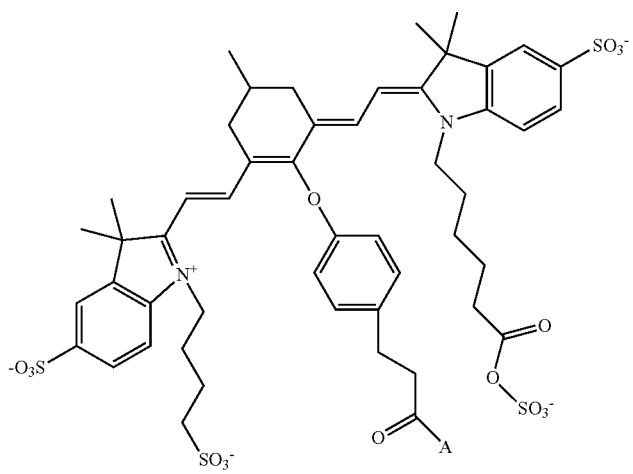

TABLE 3
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 61 | 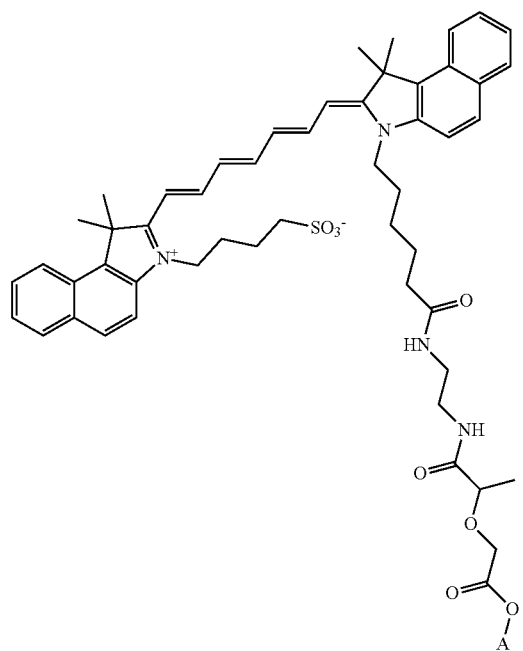 |
| 62 | 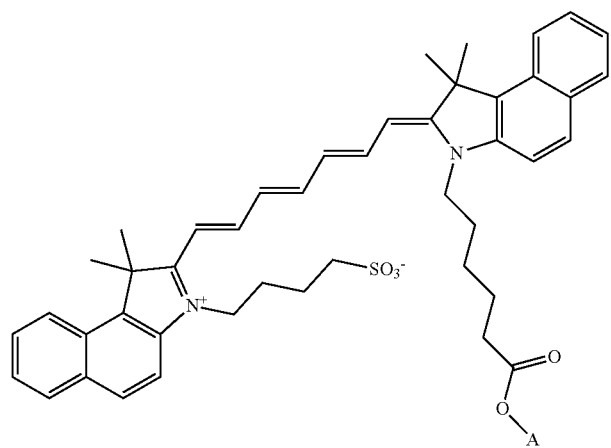 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 63 | 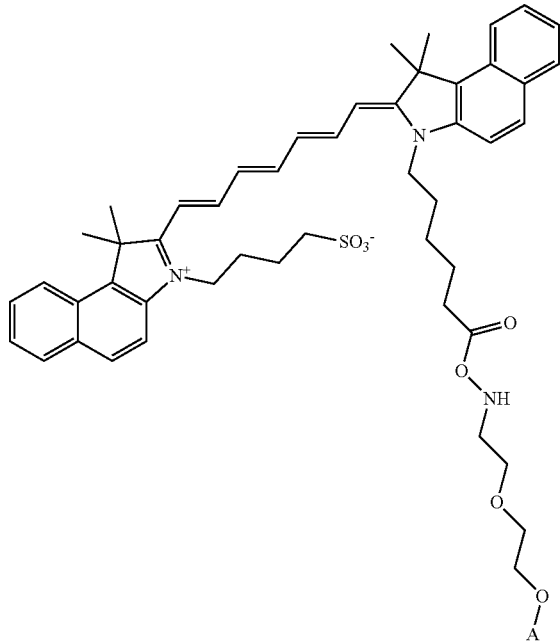 |
| 64 | 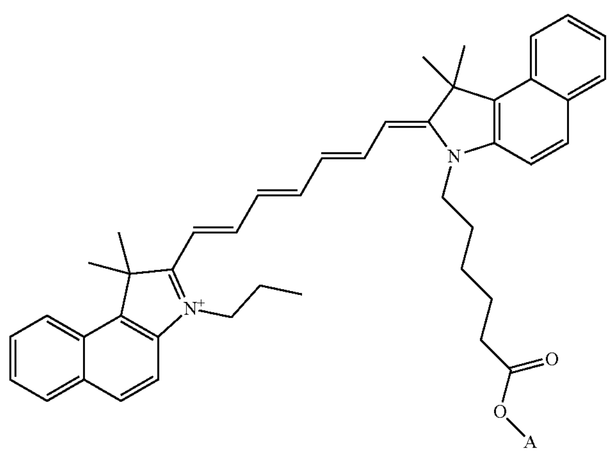 |
| 65 | 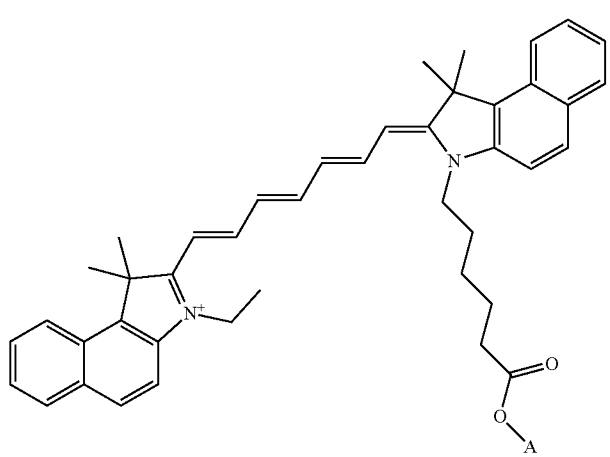 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 66 | 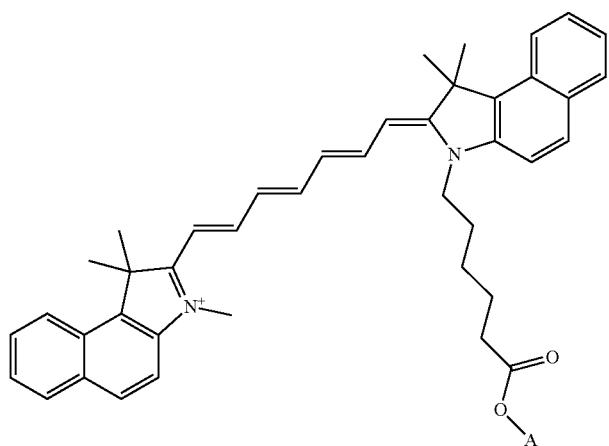 |
| 67 | 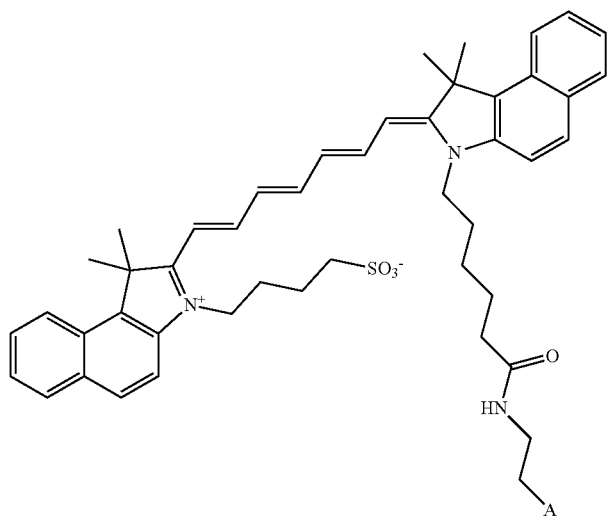 |
| 68 | 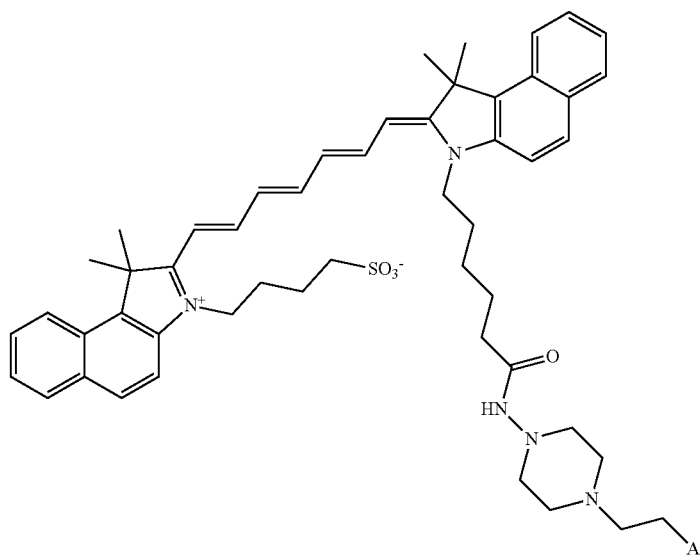 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 69 | 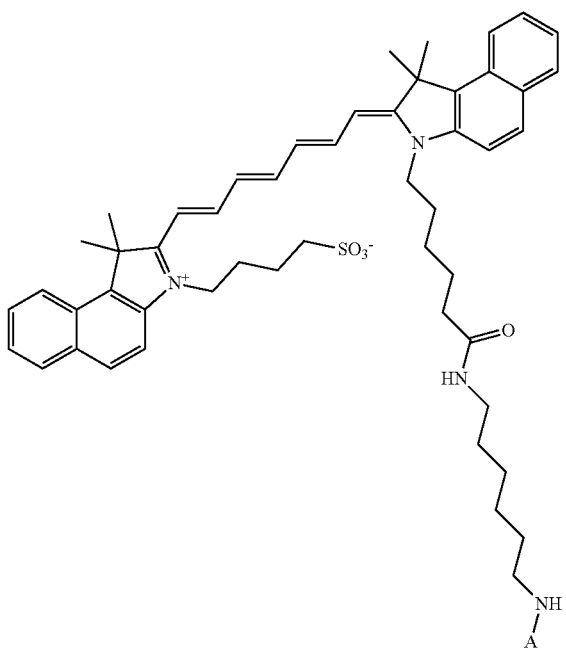 |
| 70 | 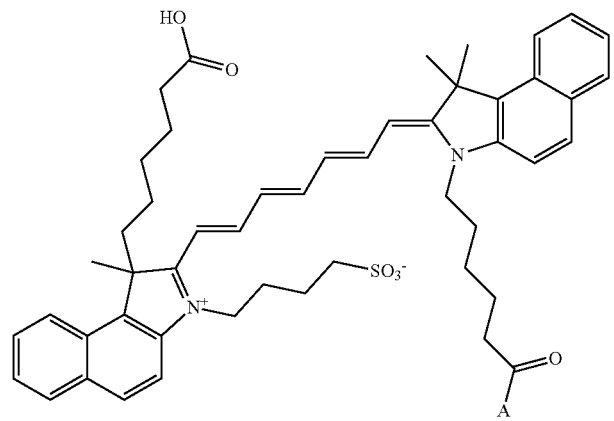 |
| 71 | 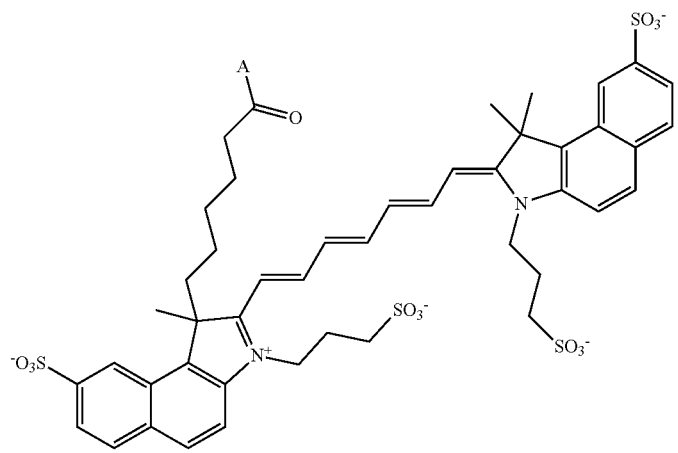 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 72 | 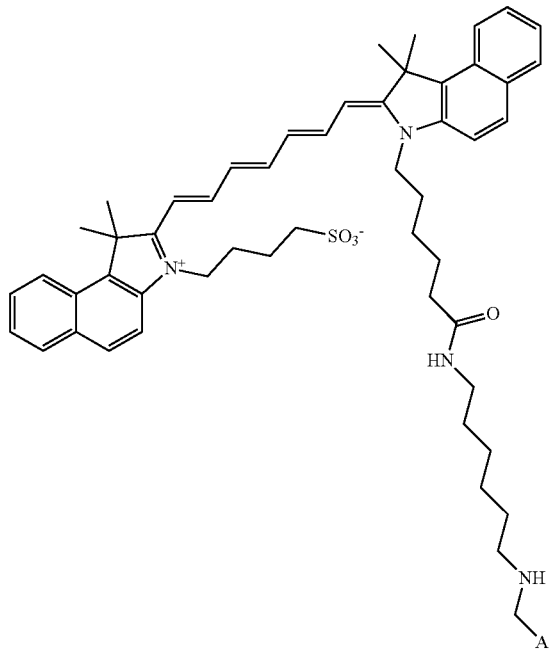 |
| 73 | 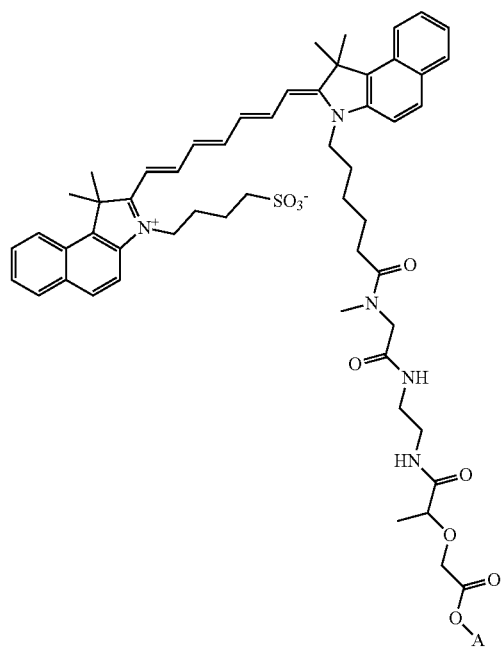 |

TABLE 3-continued

Exemplary compounds according to the present disclosure.
A = MCMPCFTTDHQMARACDDCCGGAGRGKCYGPQCLCR (SEQ ID NO: 5) (attached at K-27)

| No. | Structure |
|---|---|
| 74 | 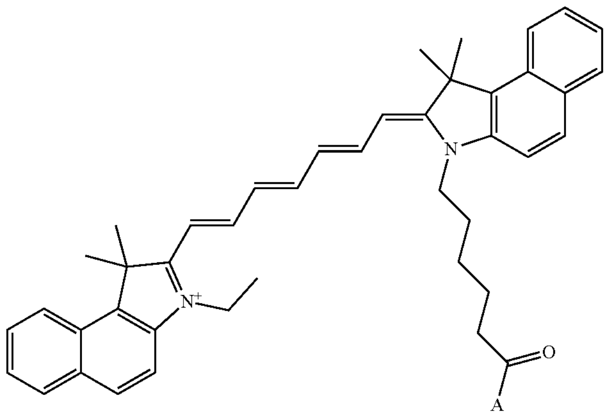 |
| 75 | 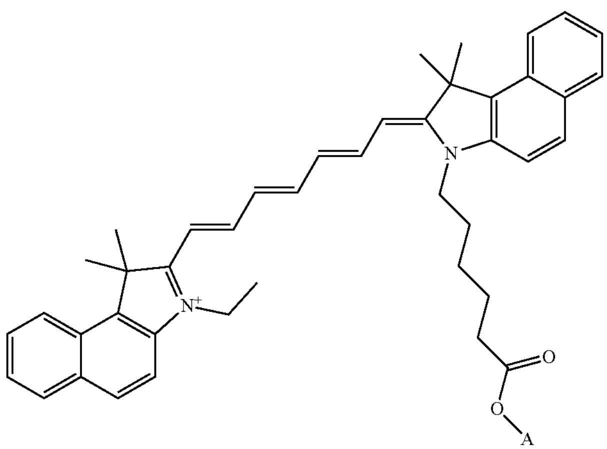 |
| 76 | 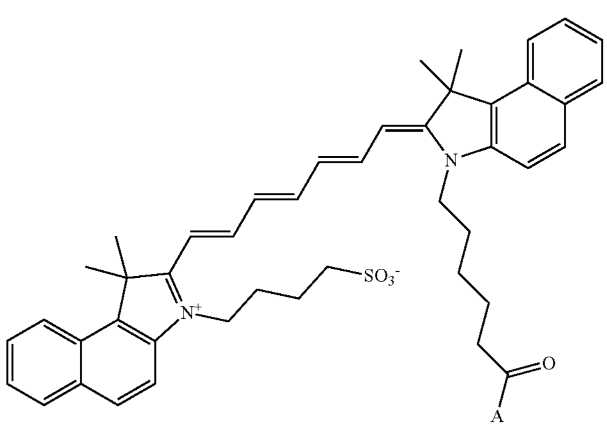 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 77 | 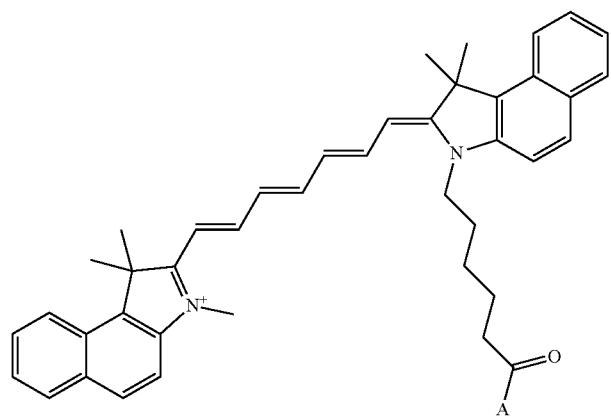 |
| 78 | 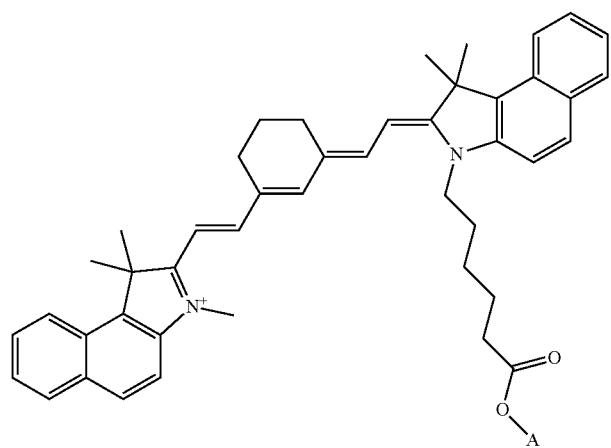 |
| 79 | 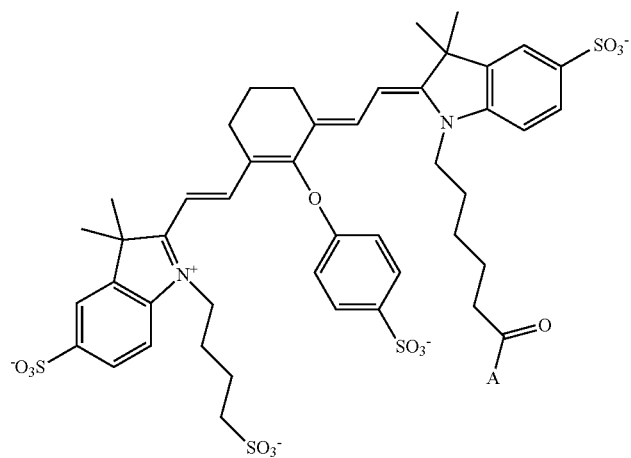 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 80 | 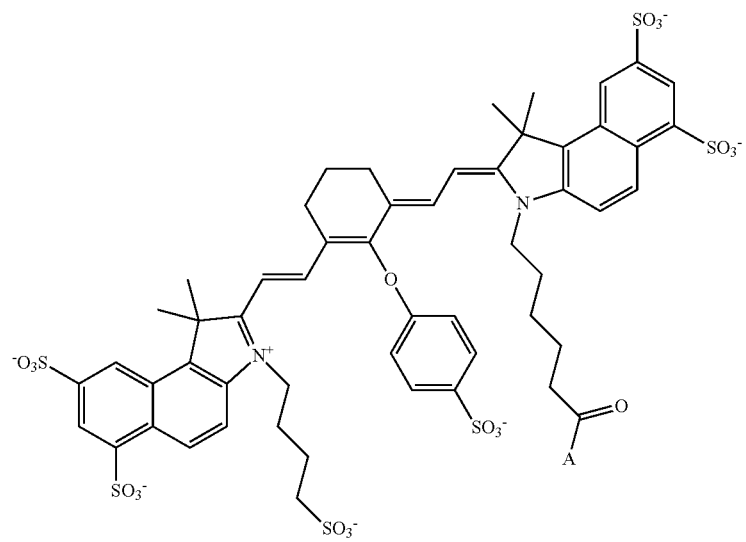 |
| 81 | 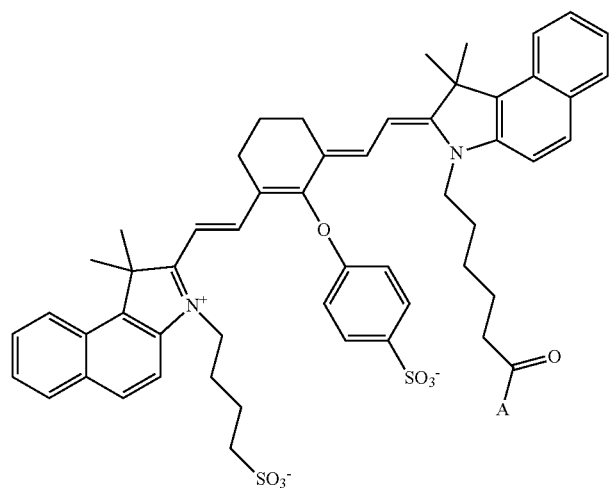 |
| 82 | 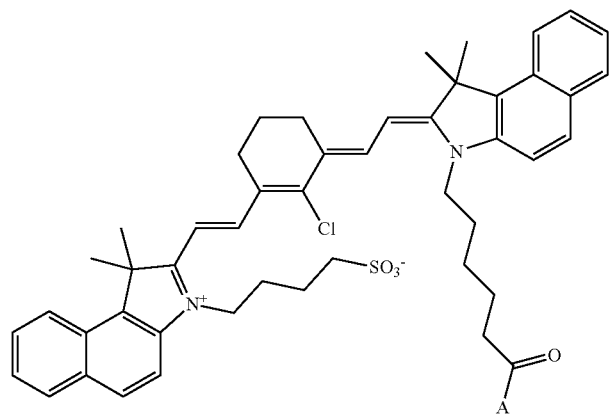 |

TABLE 3-continued

Exemplary compounds according to the present disclosure.
A = MCMPCFTTDHQMARACDDCCGGAGRGKCYGPQCLCR (SEQ ID NO: 5) (attached at K-27)

| No. | Structure |
| --- | --- |
| 83 | 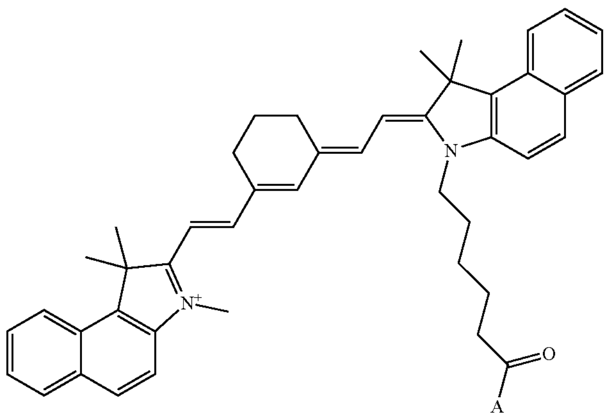 |
| 84 | 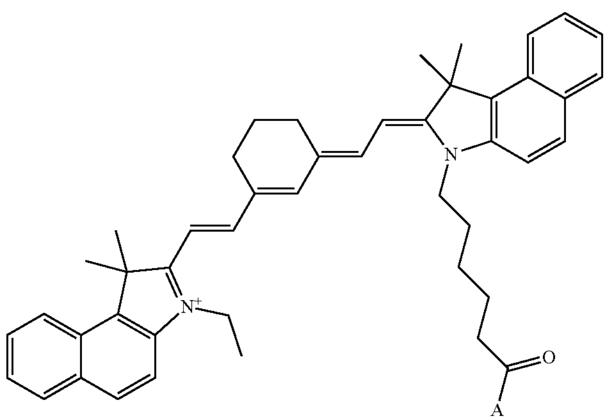 |
| 85 | 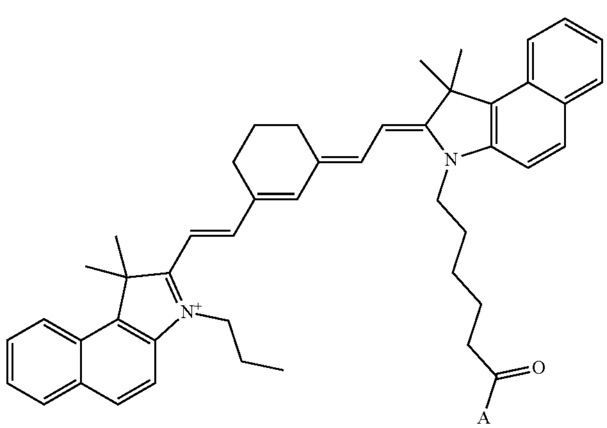 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|-----|-----------|
| 86  | 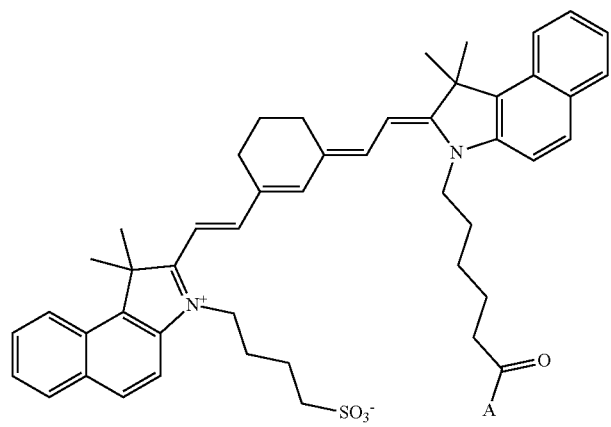 |
| 87  | 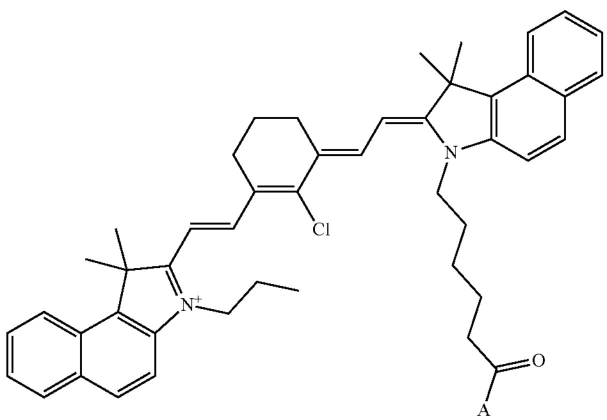 |
| 88  | 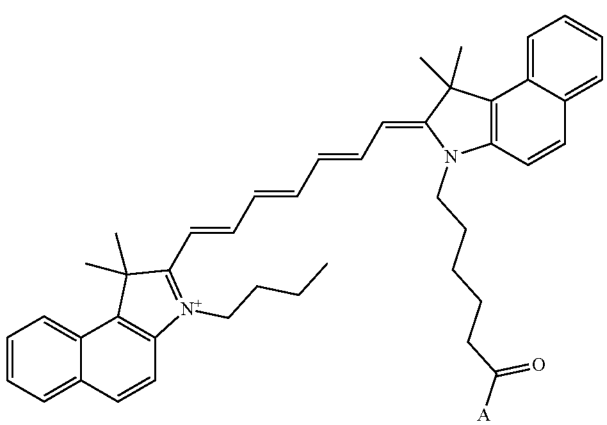 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 89 | 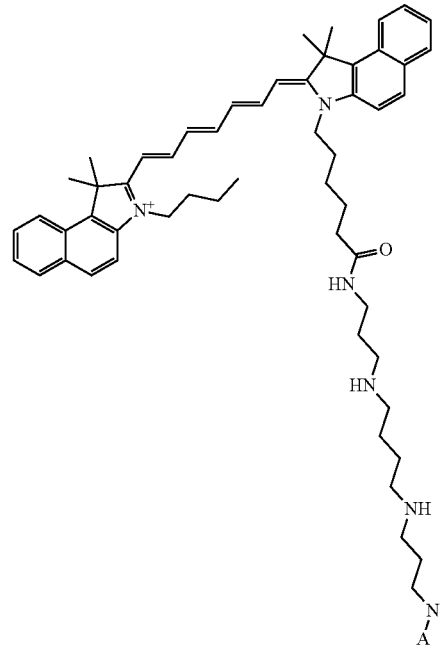 |
| 90 | 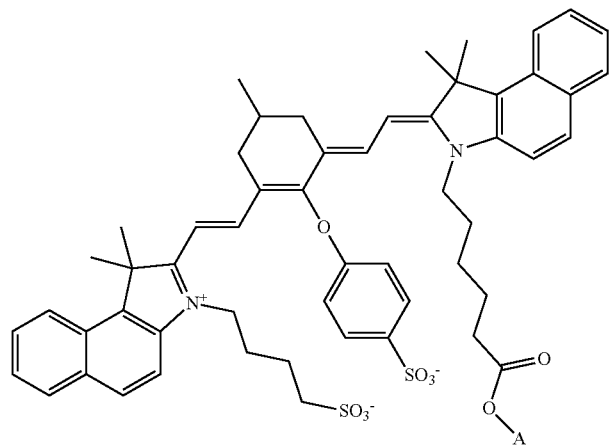 |
| 91 | 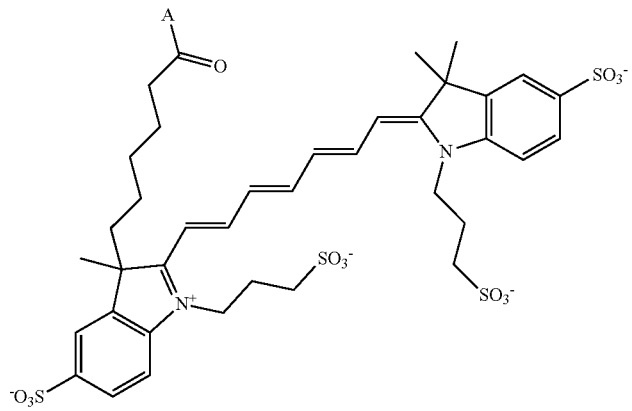 |

251
252
TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 92 | 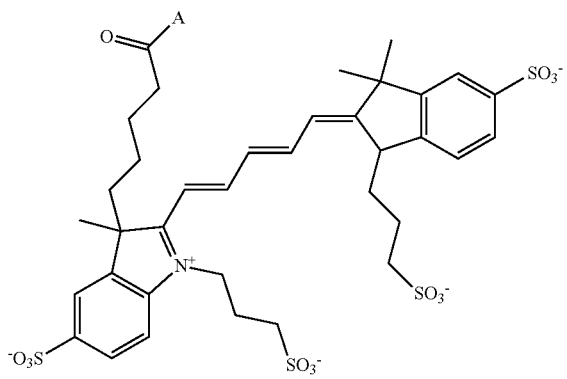 |
| 93 | 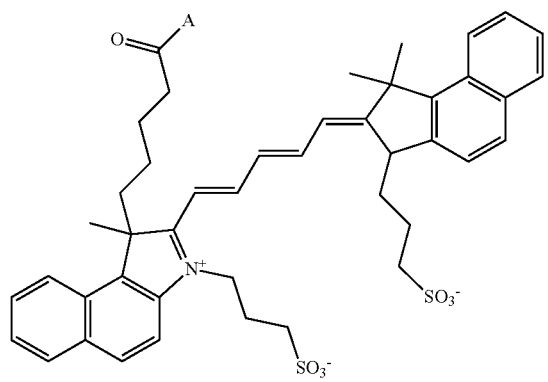 |
| 94 | 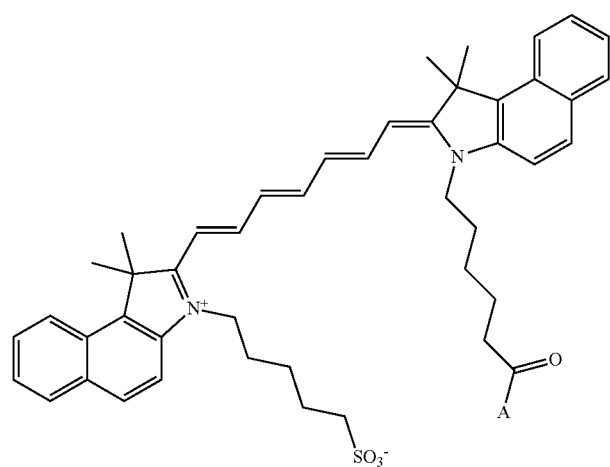 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 95 | 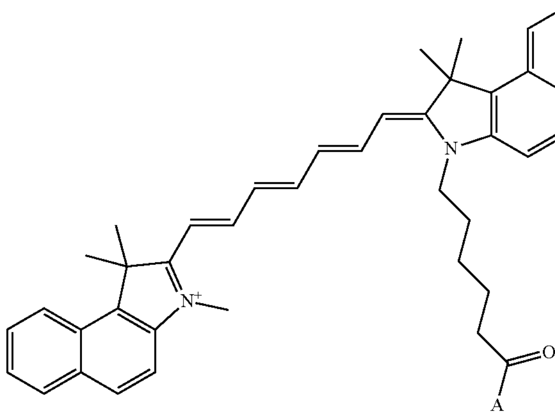 |
| 96 | 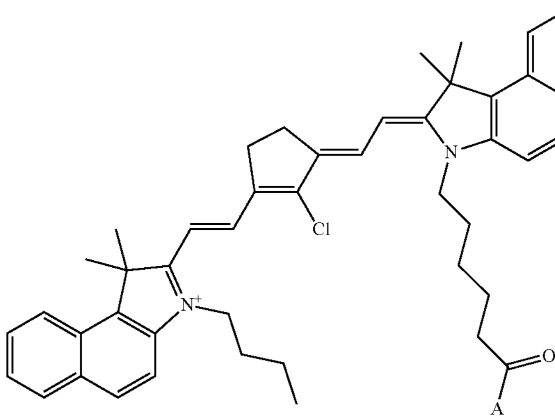 |
| 97 | 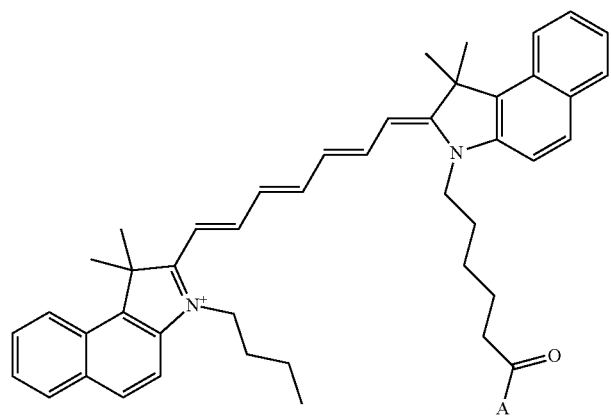 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 98 | 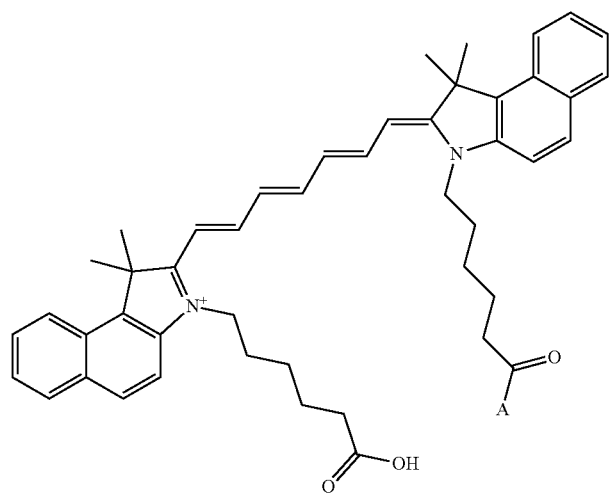 |
| 99 | 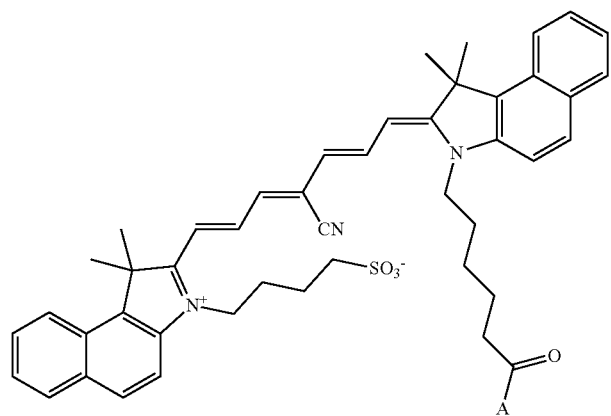 |
| 100 | 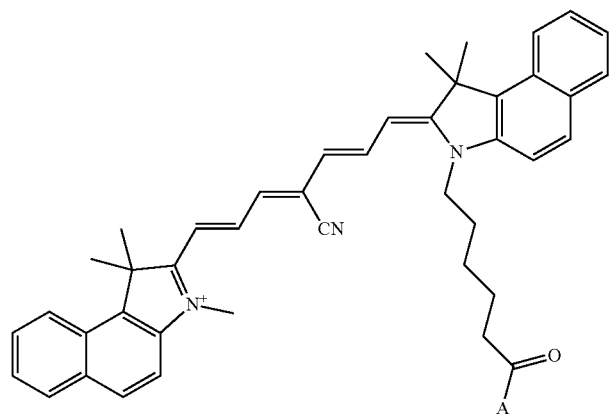 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 101 | 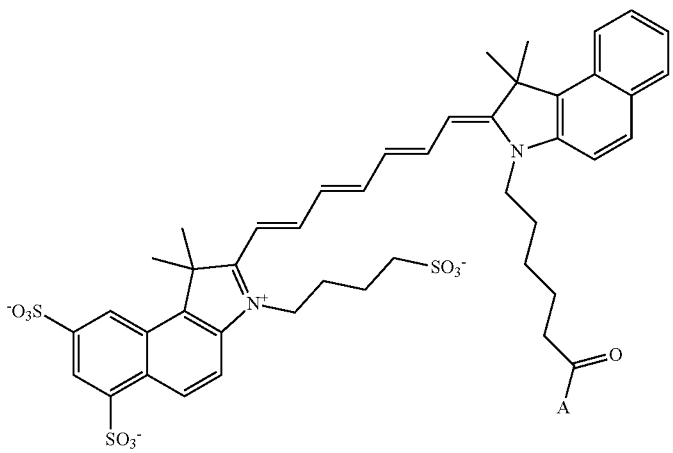 |
| 102 | 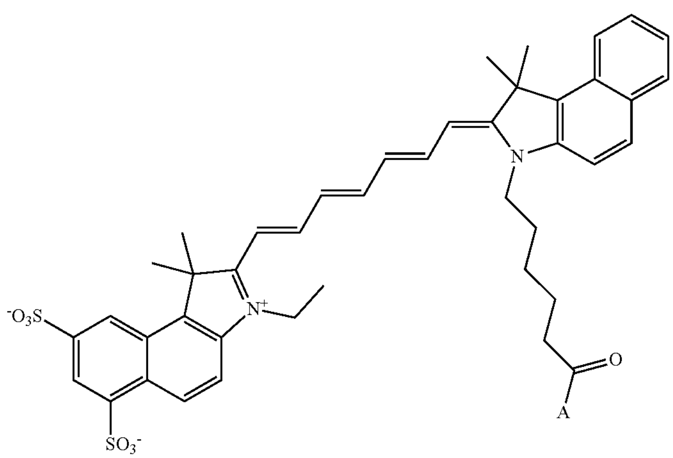 |
| 103 | 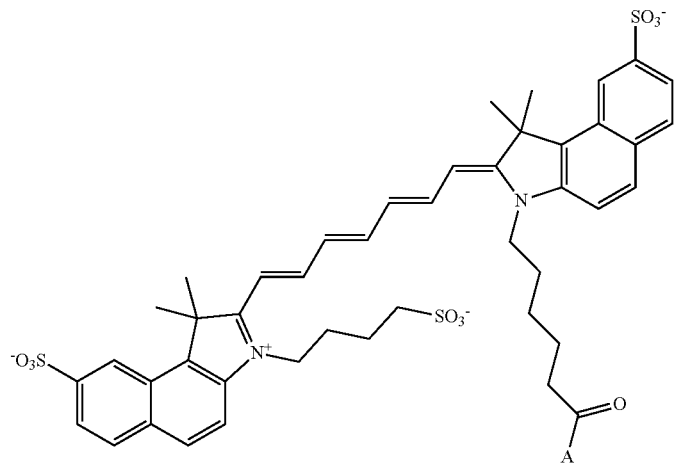 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
| --- | --- |
| 104 | 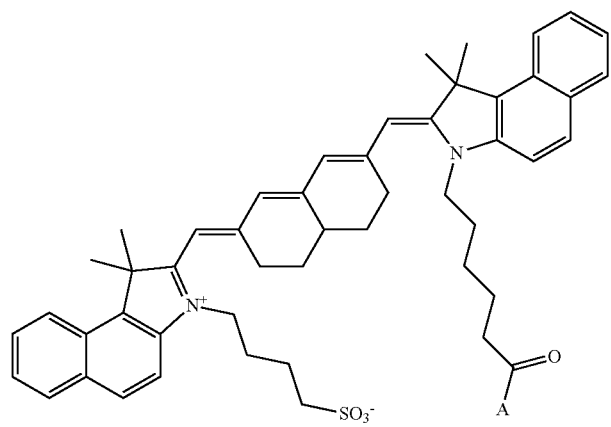 |
| 105 | 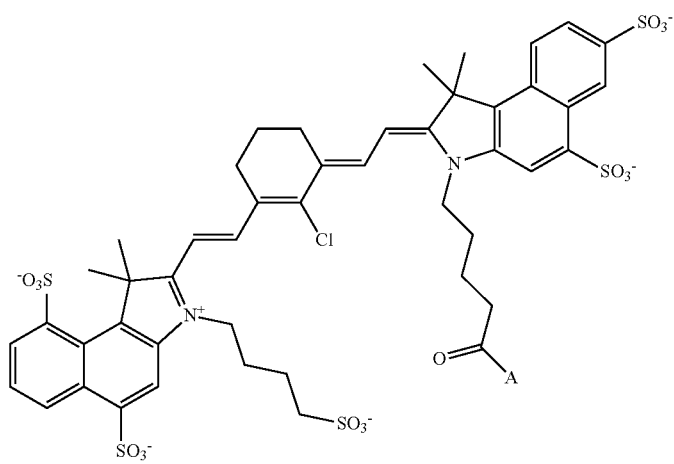 |
| 106 | 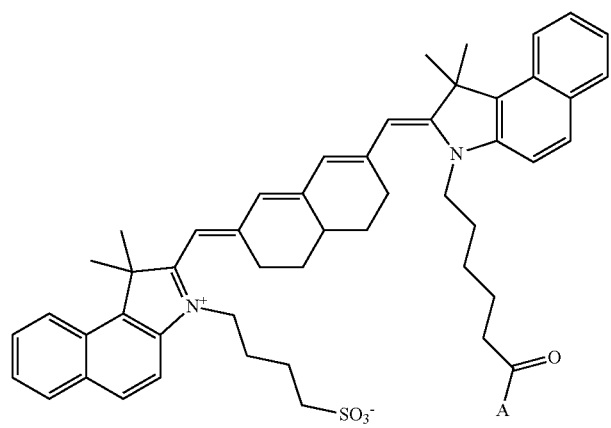 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
| --- | --- |
| 107 | 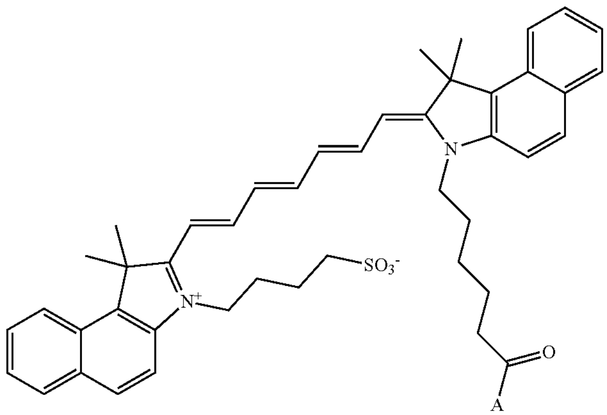 |
| 108 | 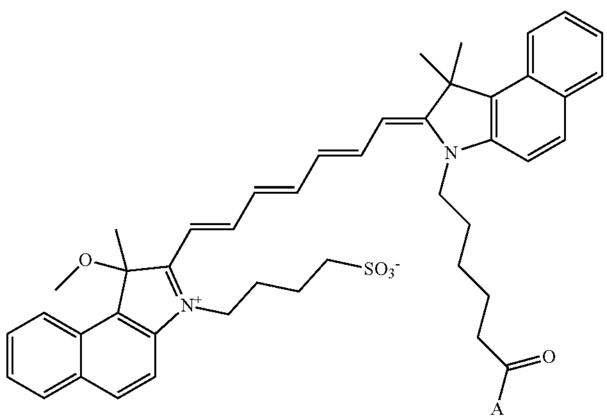 |
| 109 | 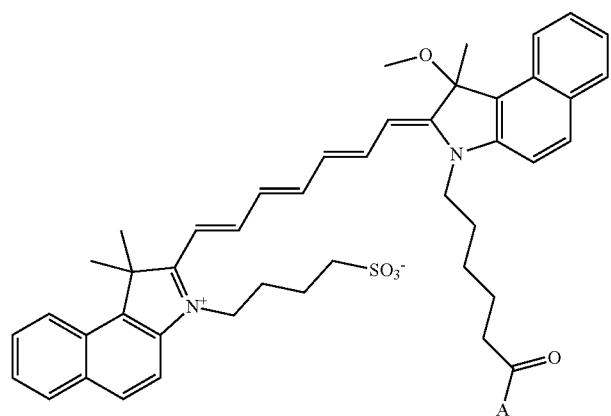 |

TABLE 3-continued

Exemplary compounds according to the present disclosure.
A = MCMPCFTTDHQMARACDDCCGGAGRGKCYGPQCLCR (SEQ ID NO: 5) (attached at K-27)

| No. | Structure |
|---|---|
| 110 | 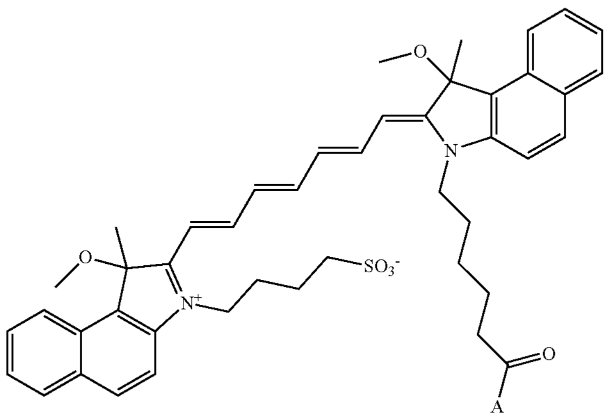 |
| 111 | 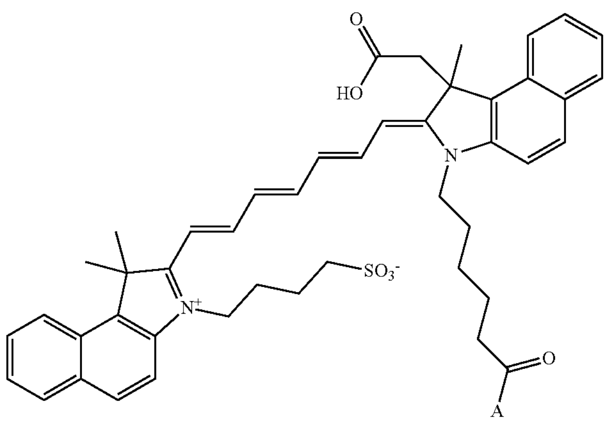 |
| 112 | 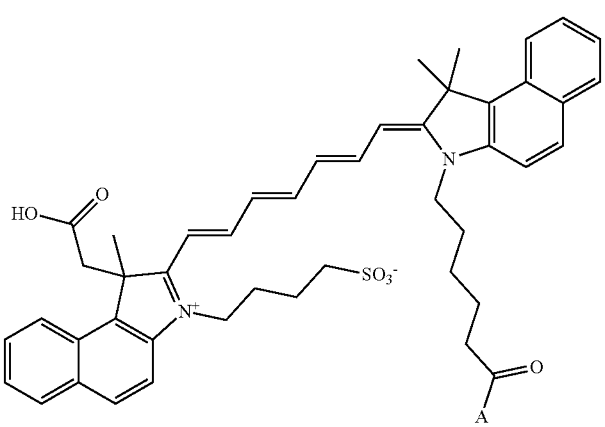 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 113 | 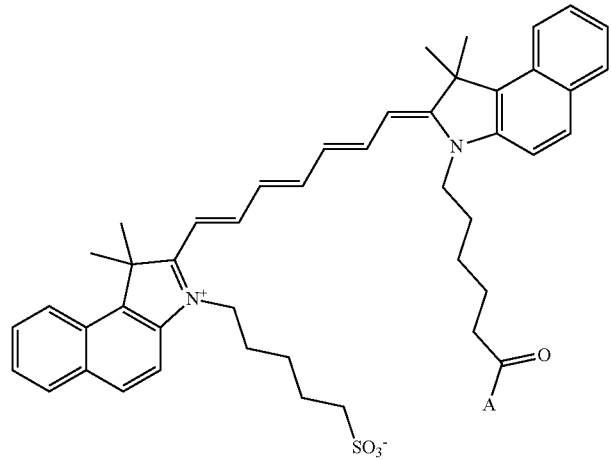 |
| 114 | 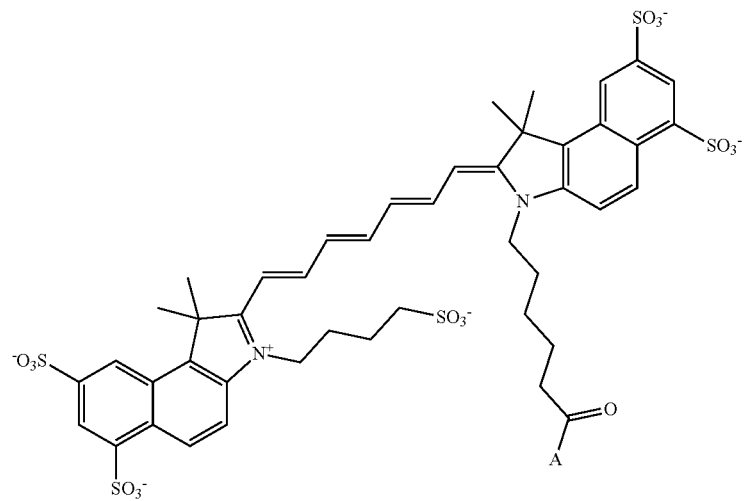 |
| 115 | 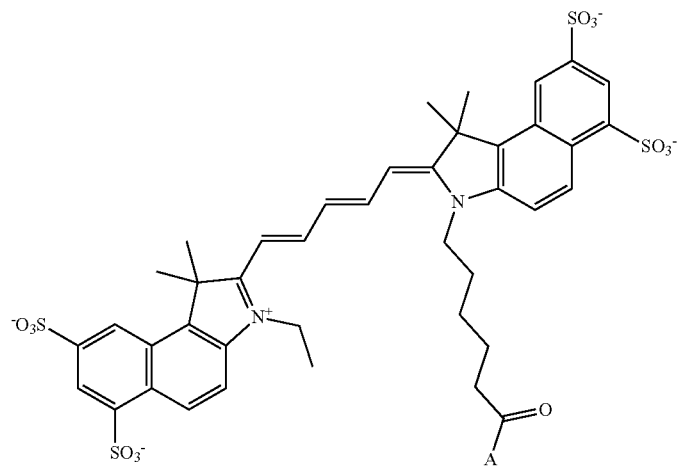 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 116 | 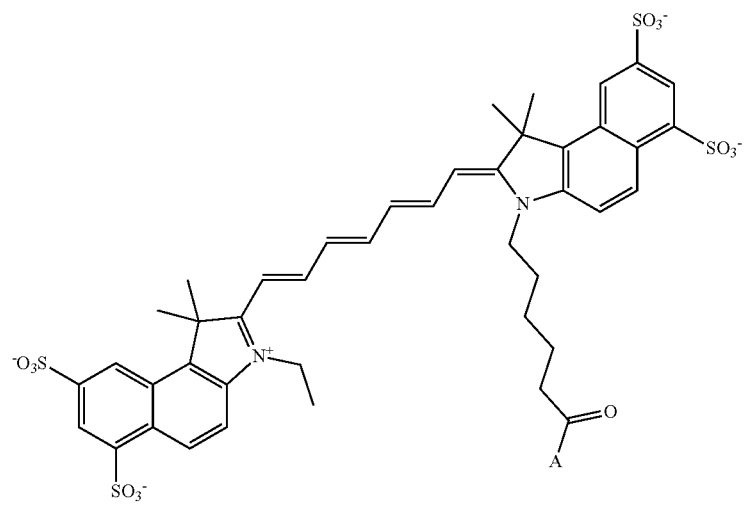 |
| 117 | 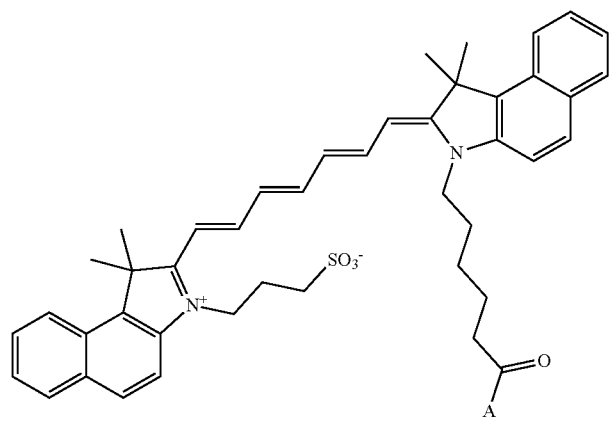 |
| 118 | 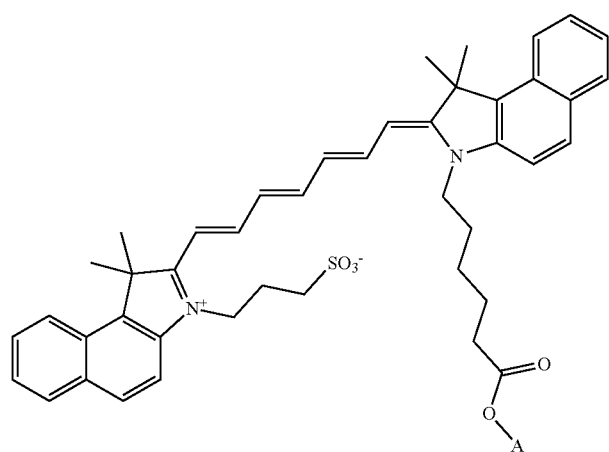 |

TABLE 3-continued
Exemplary compounds according to the present disclosure.
A = MCMPCFTTDHQMARACDDCCGGAGRGKCYGPQCLCR (SEQ ID NO: 5) (attached at K-27)
| No. | Structure |
|---|---|
| 119 | 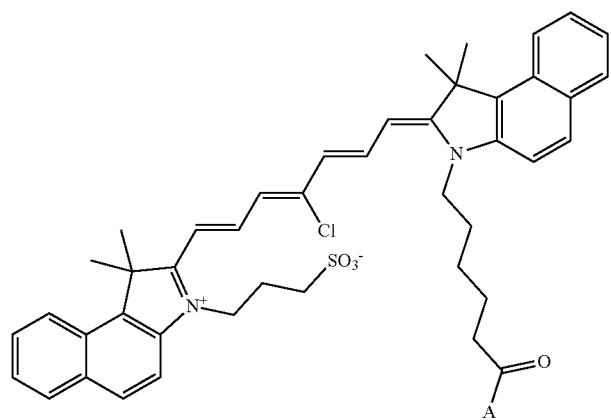 |
| 120 | 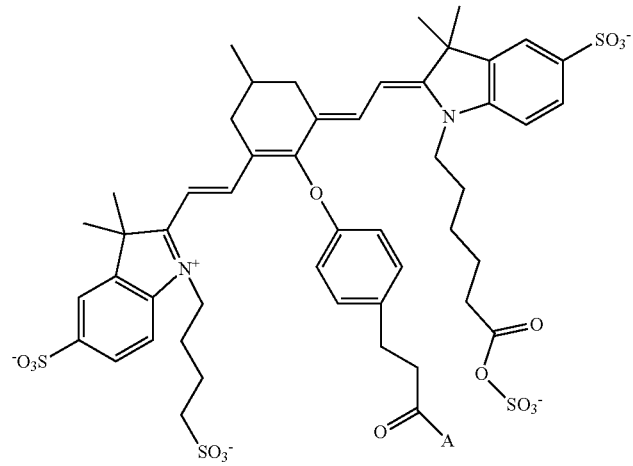 |

TABLE 4
Exemplary compounds according to the present disclosure.
A = MCMPCFTTDHQMARRCDDCCGGAGRGKCYGPQCLCR (SEQ ID NO: 6) (attached at K-27)
| No. | Structure |
| --- | --- |
| 121 | 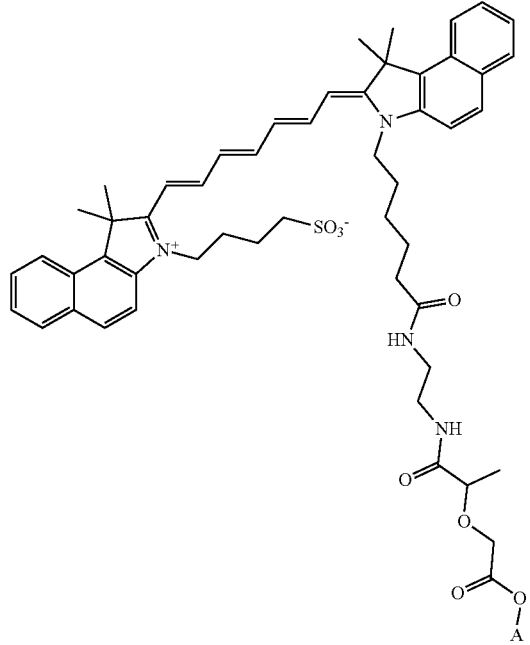 |
| 122 | 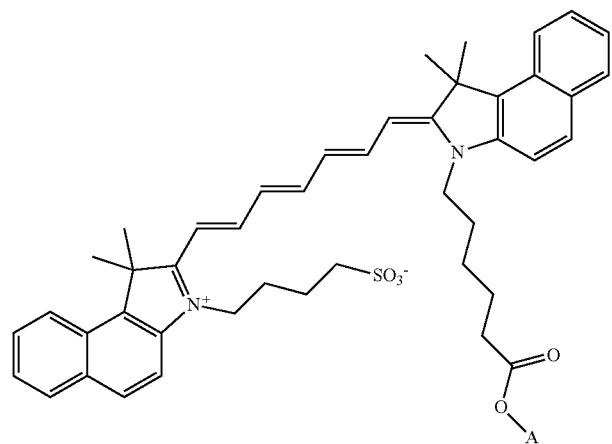 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
| --- | --- |
| 123 | 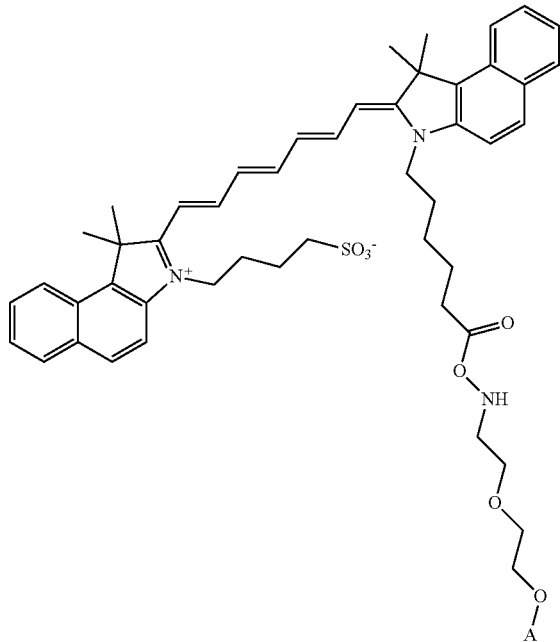 |
| 124 | 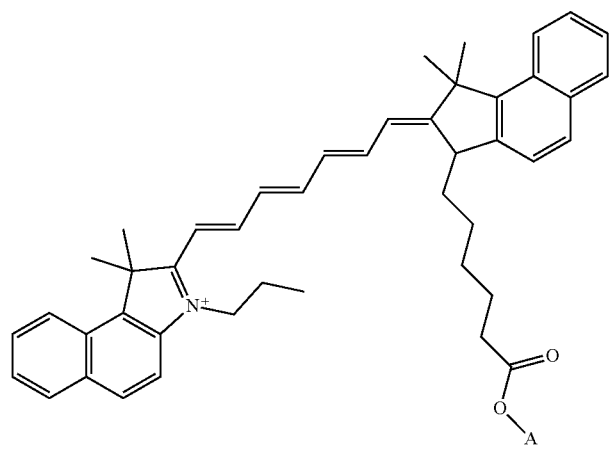 |
| 125 | 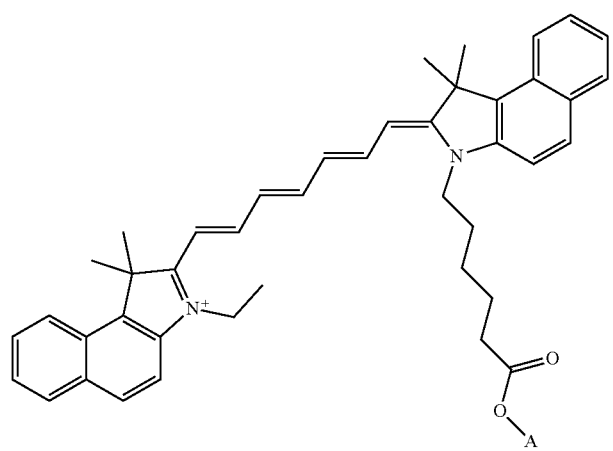 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 126 | 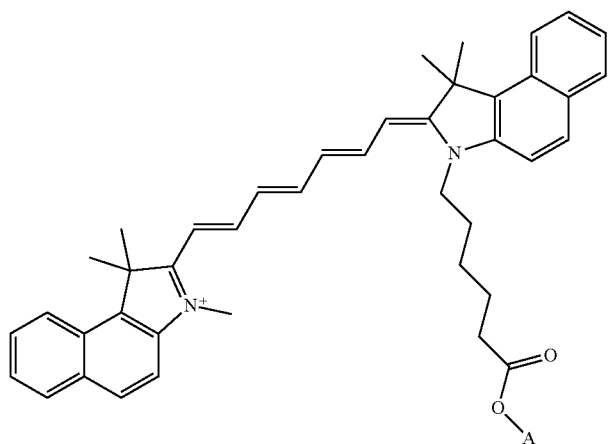 |
| 127 | 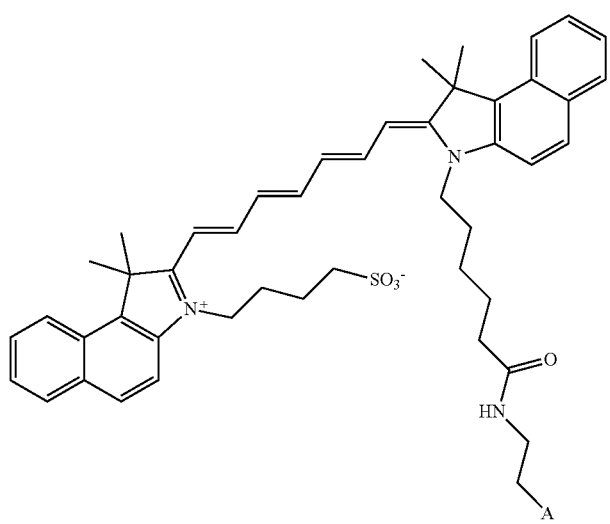 |
| 128 | 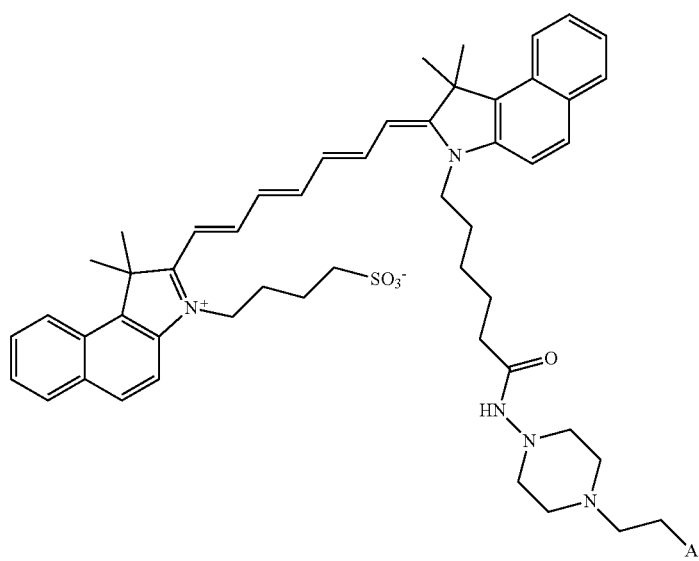 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 129 | 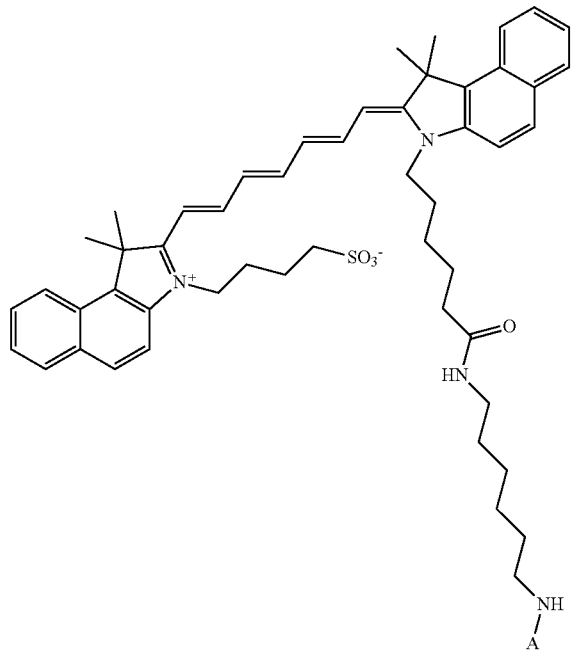 |
| 130 | 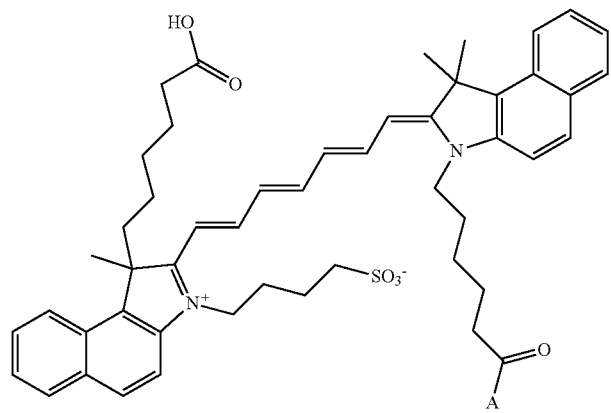 |
| 131 | 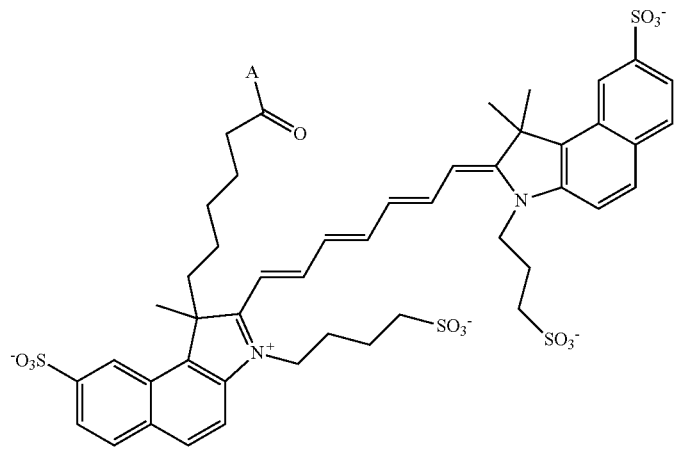 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 132 | 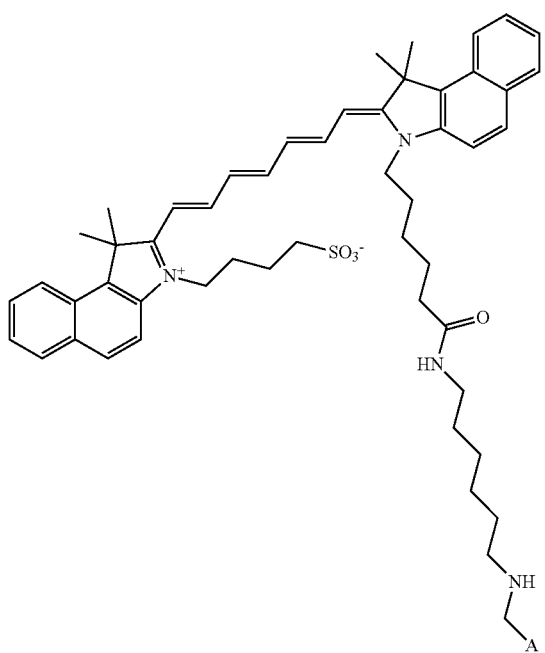 |
| 133 | 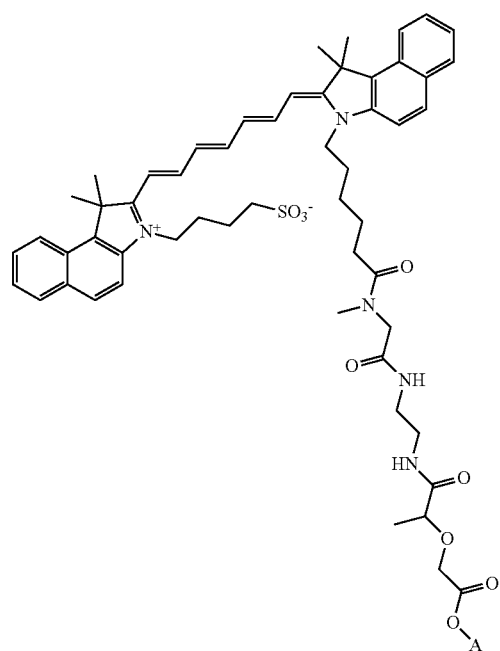 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|-----|-----------|
| 134 | 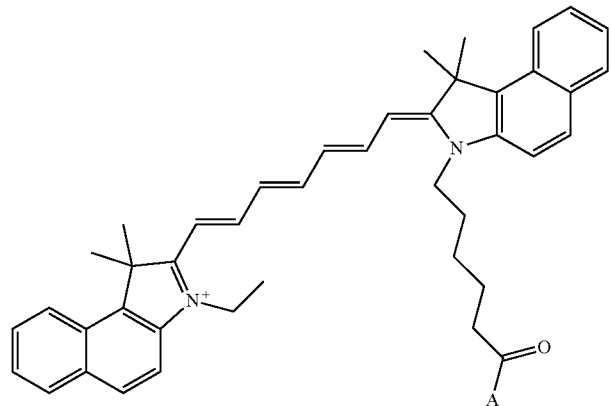 |
| 135 | 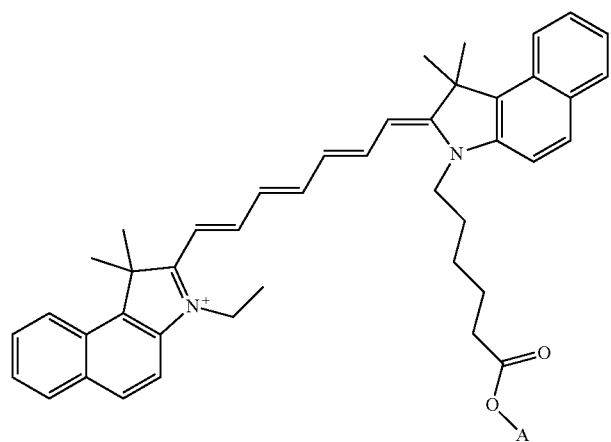 |
| 136 | 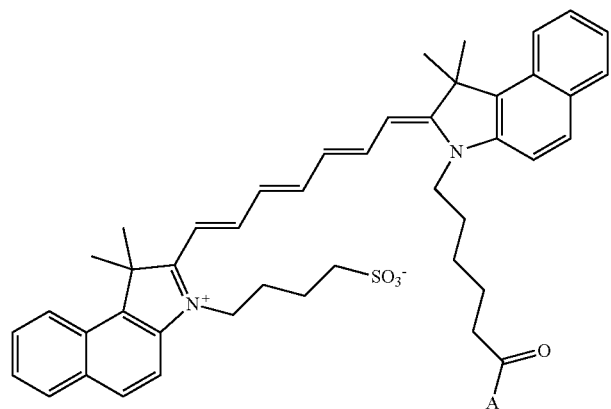 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 137 | 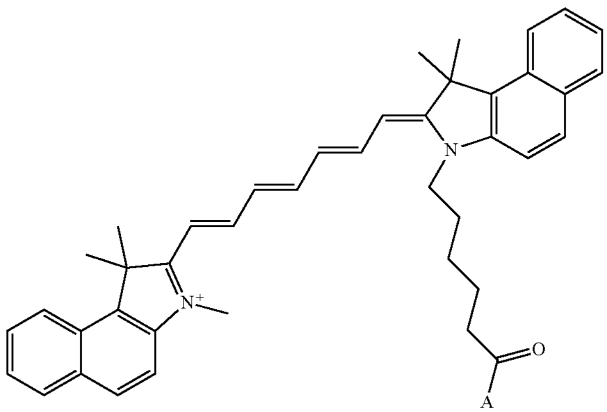 |
| 138 | 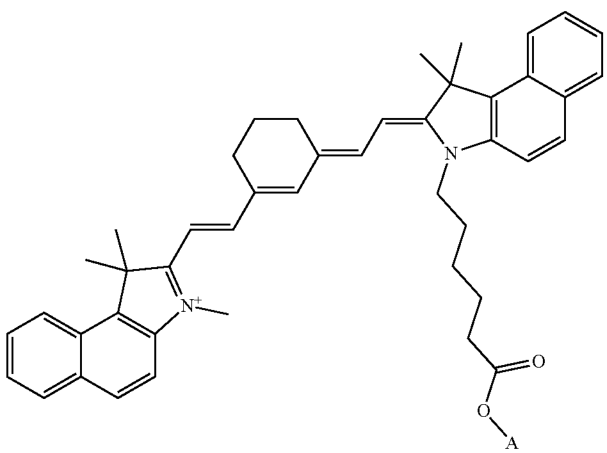 |
| 139 | 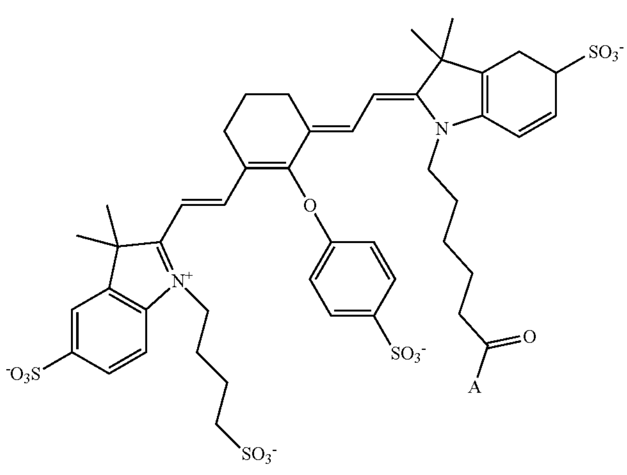 |
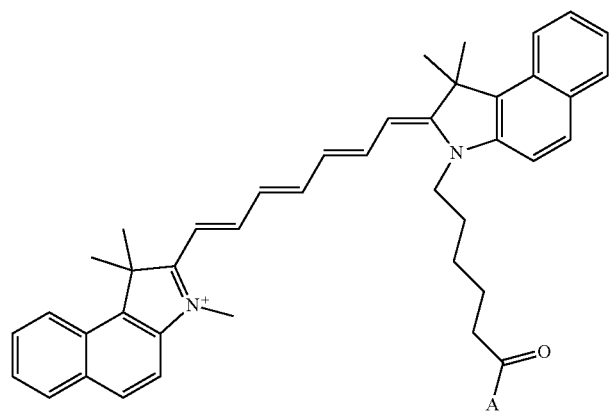
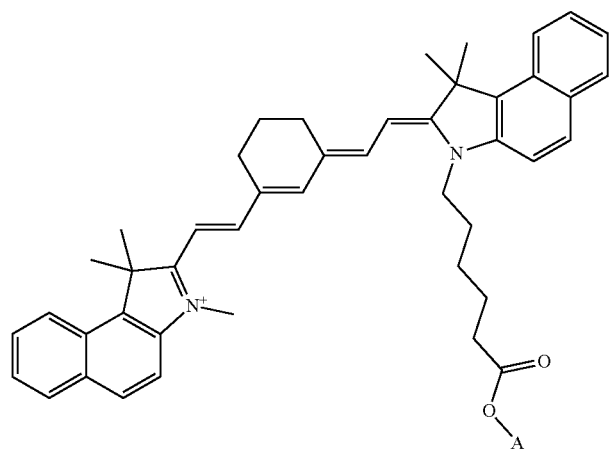
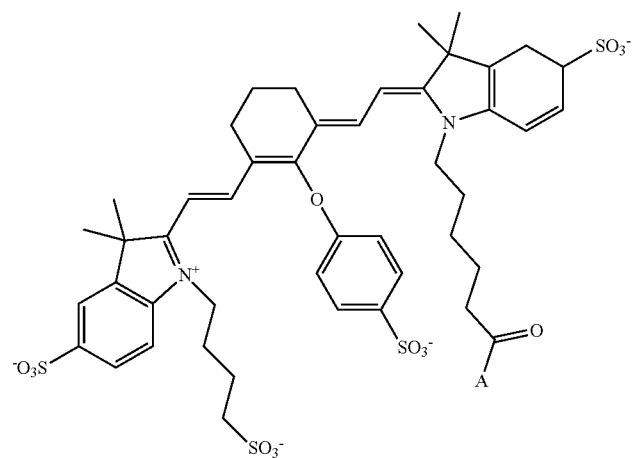

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 140 | 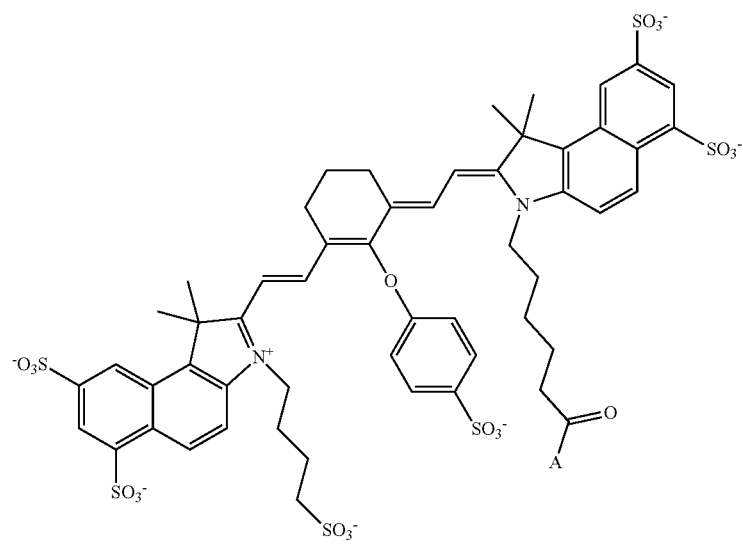 |
| 141 | 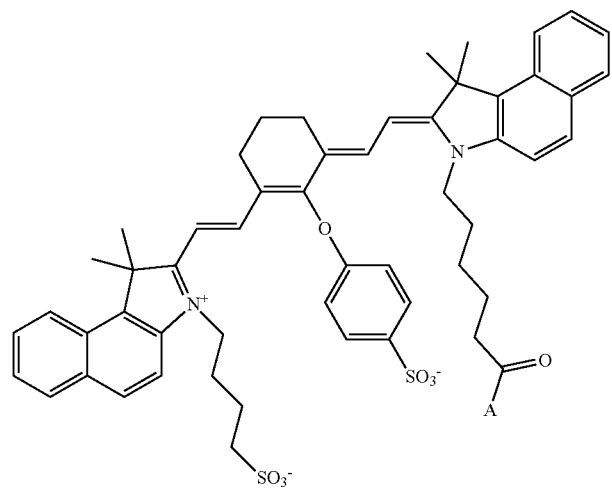 |
| 142 | 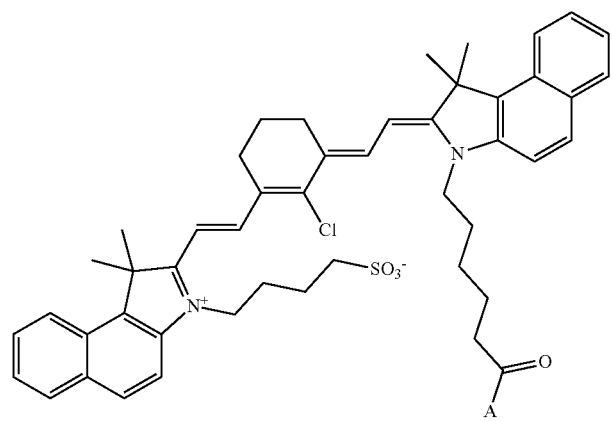 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 143 | 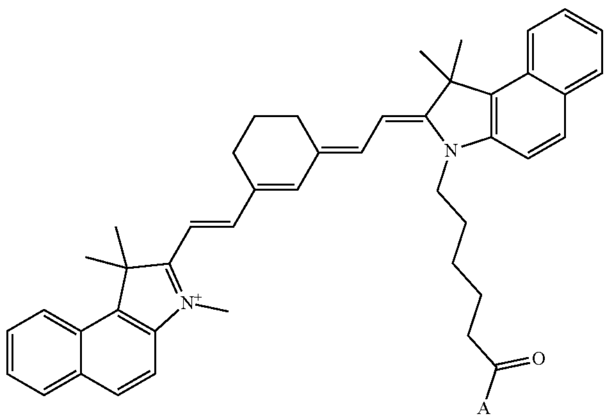 |
| 144 | 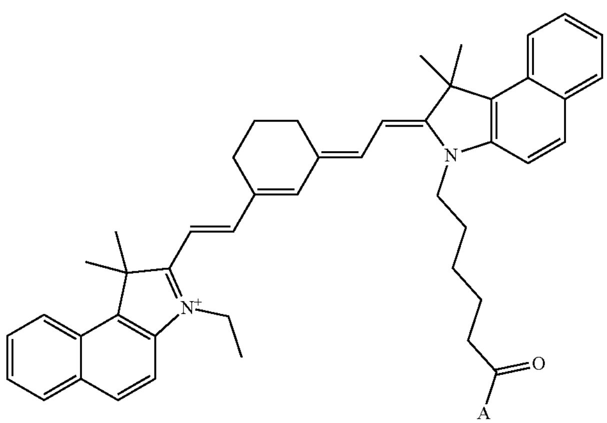 |
| 145 | 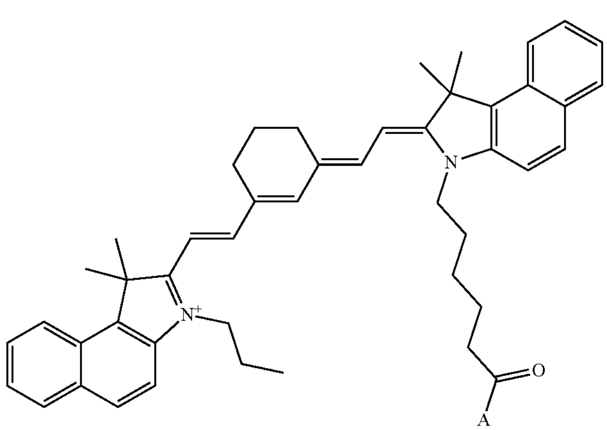 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 146 | 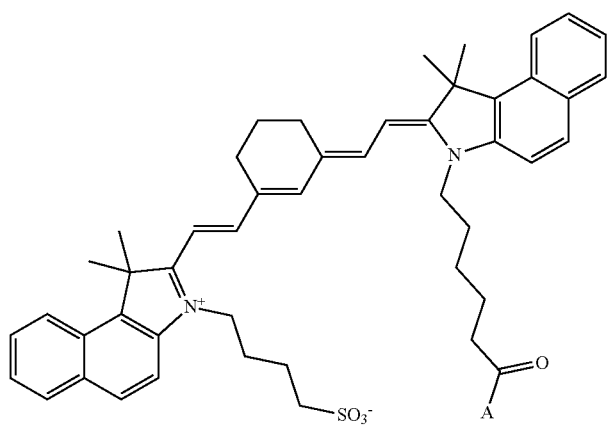 |
| 147 | 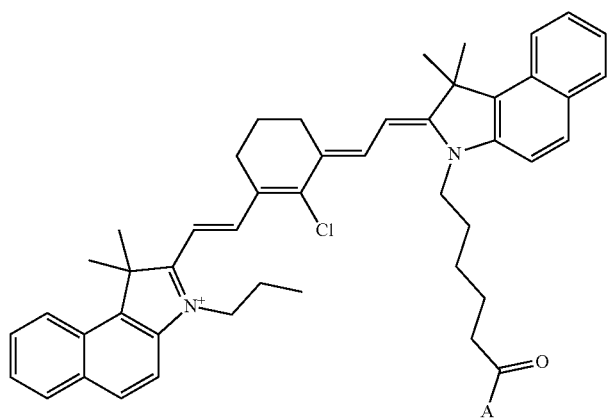 |
| 148 | 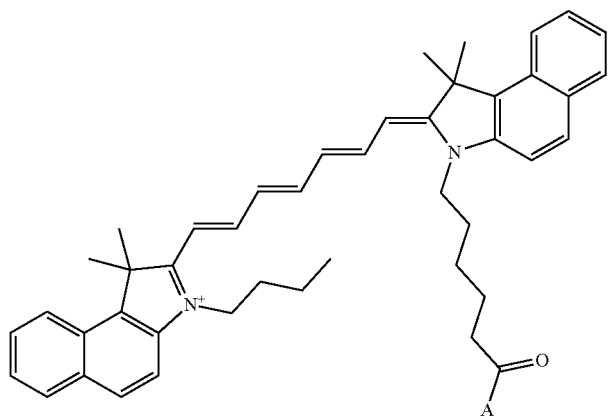 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 149 | 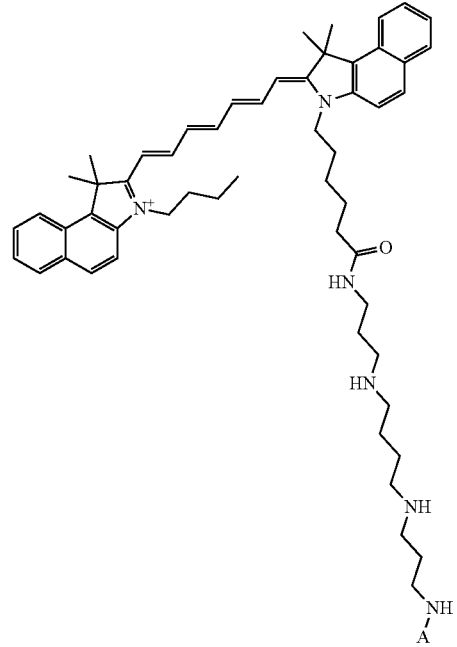 |
| 150 | 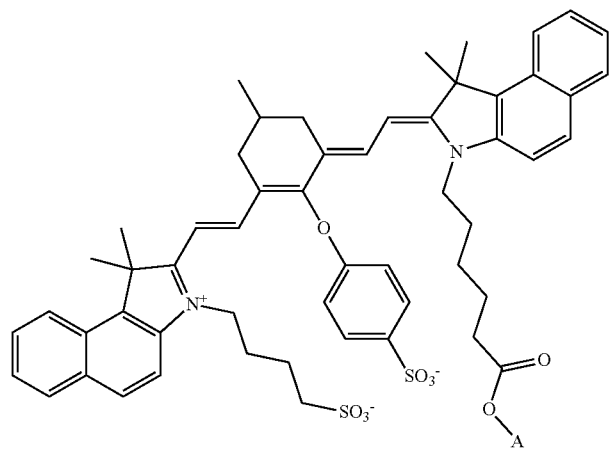 |
| 151 | 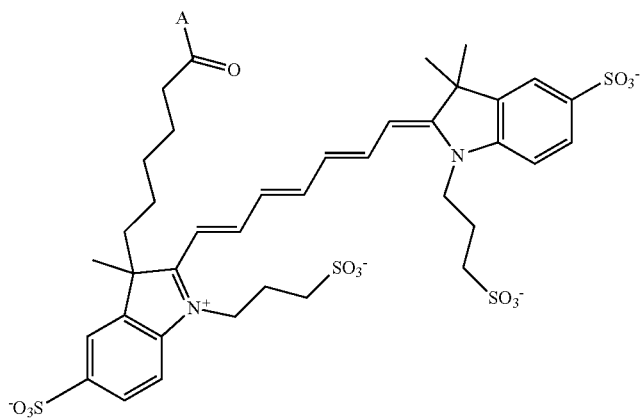 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 152 | 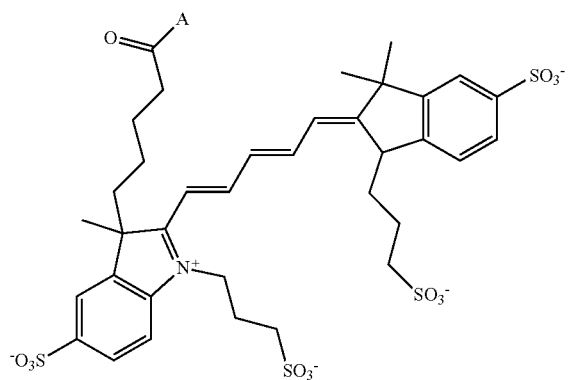 |
| 153 | 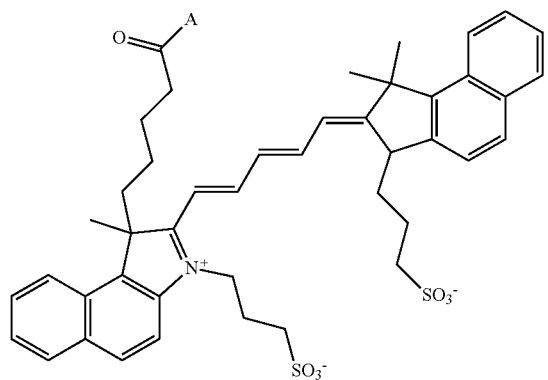 |
| 154 | 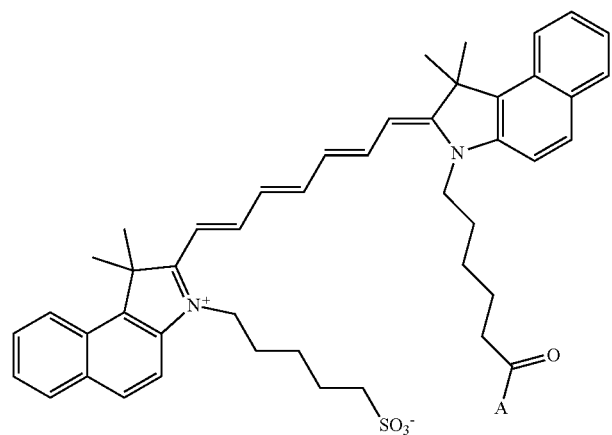 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 155 | 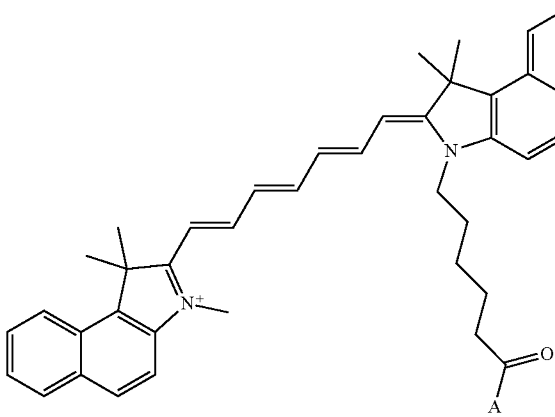 |
| 156 | 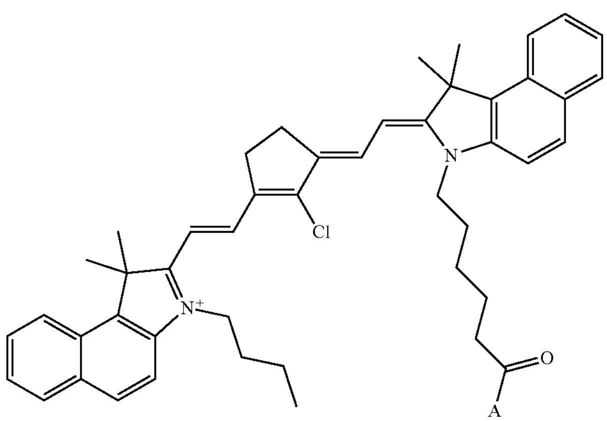 |
| 157 | 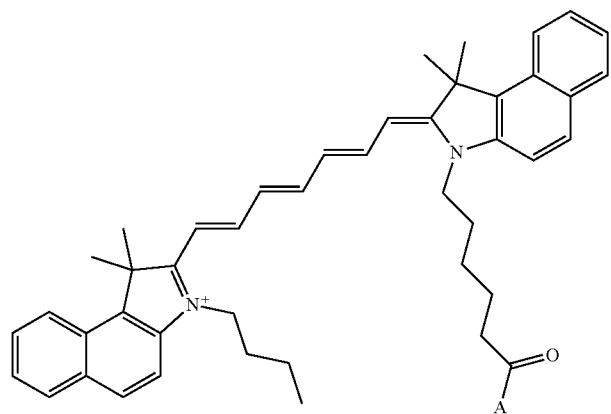 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 158 | 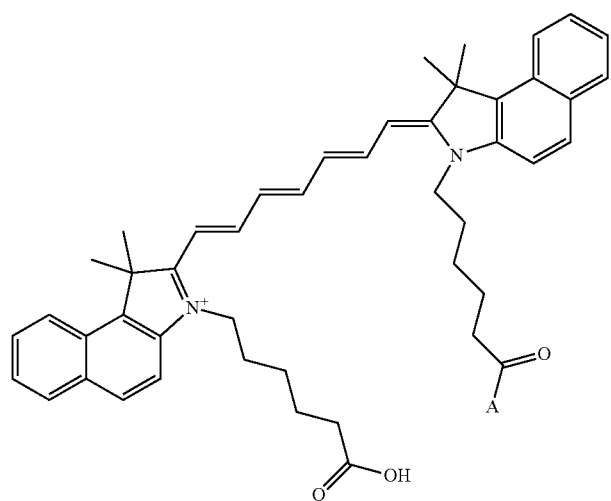 |
| 159 | 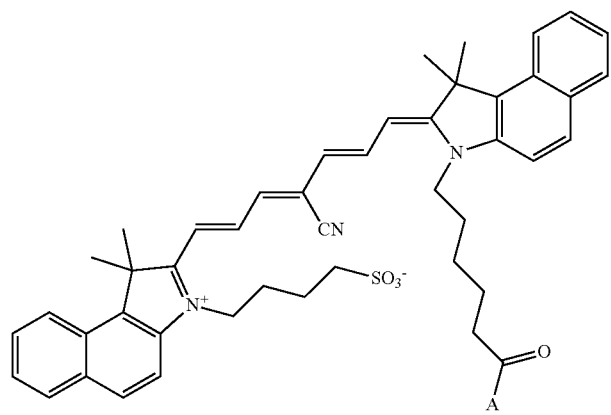 |
| 160 | 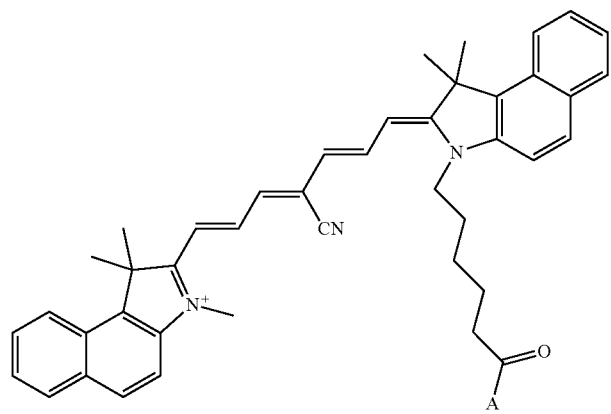 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 161 | 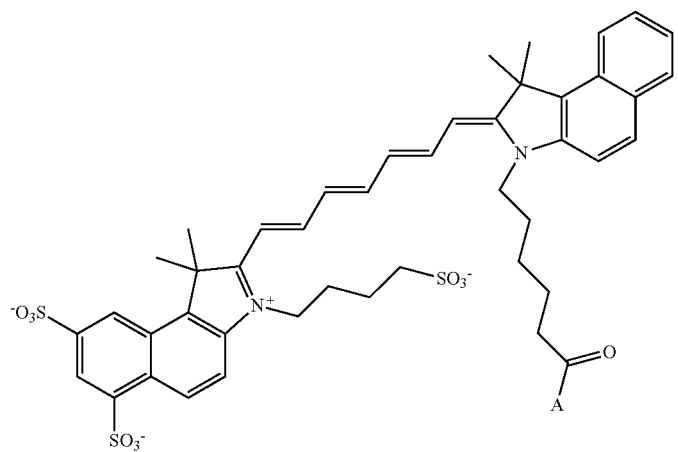 |
| 162 | 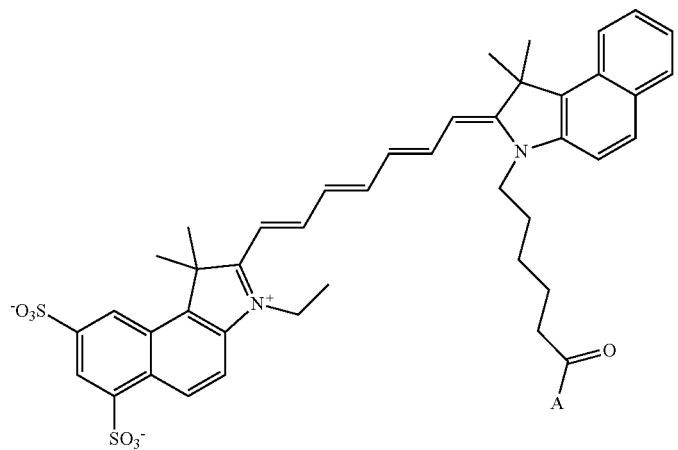 |
| 163 | 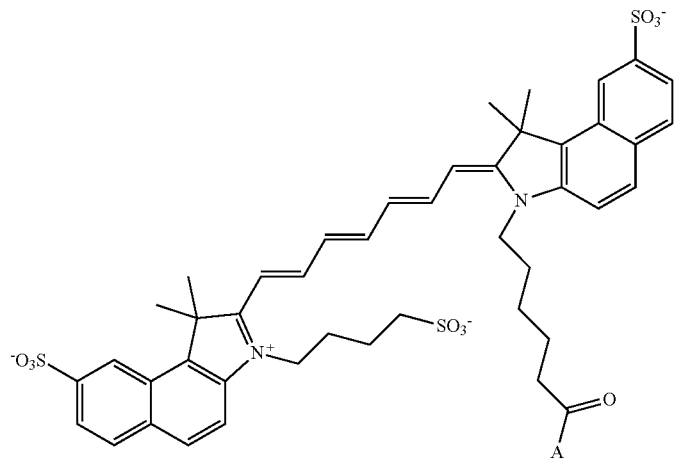 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
| --- | --- |
| 164 | 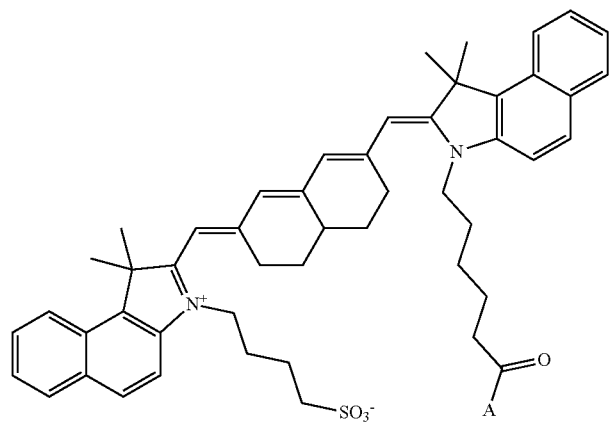 |
| 165 | 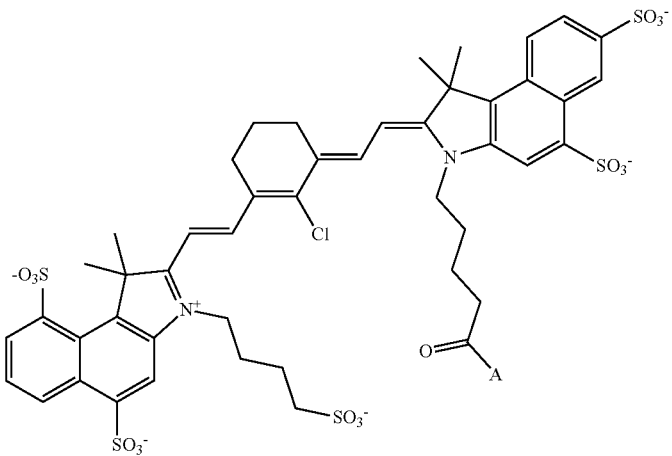 |
| 166 | 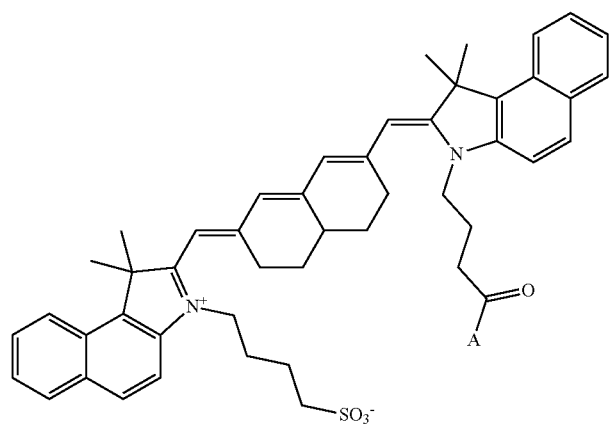 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
| --- | --- |
| 167 | 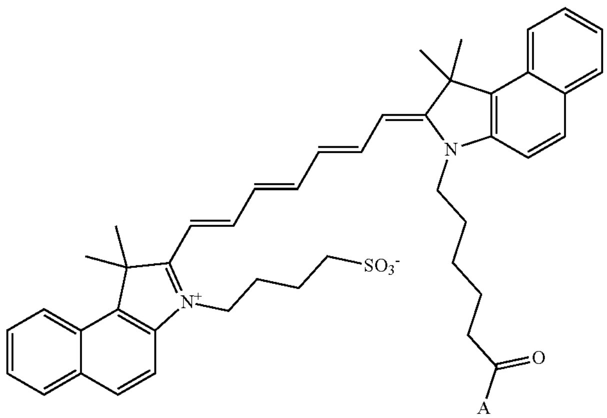 |
| 168 | 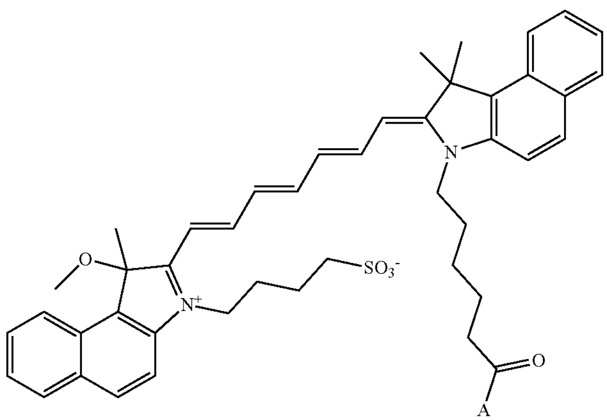 |
| 169 | 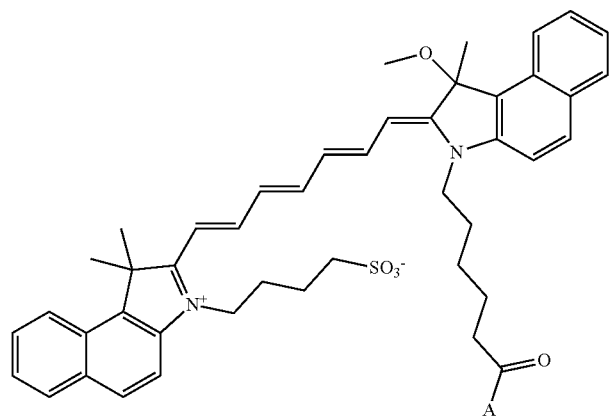 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 170 | 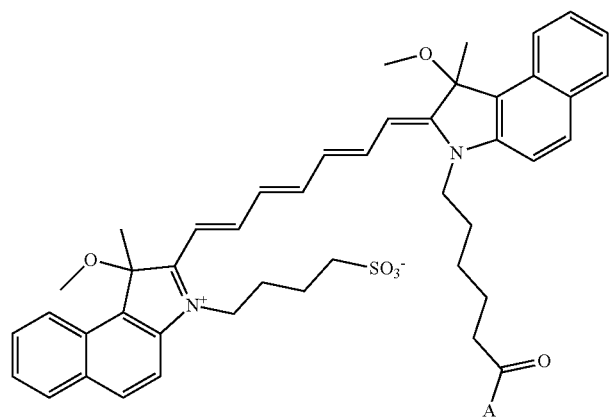 |
| 171 | 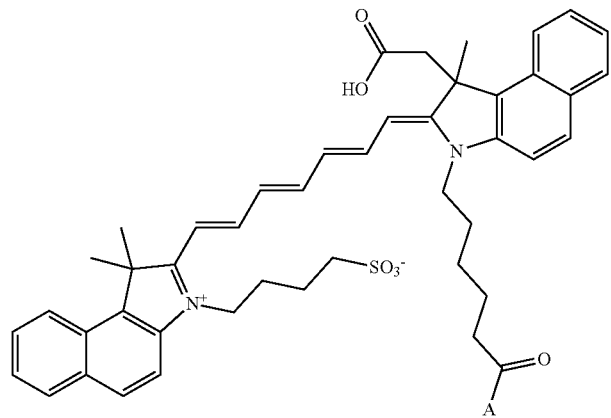 |
| 172 | 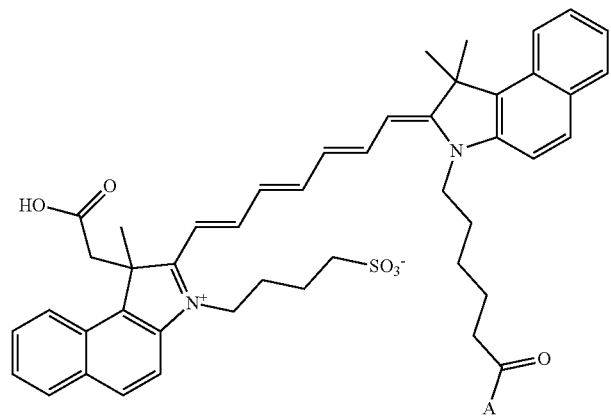 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 173 | 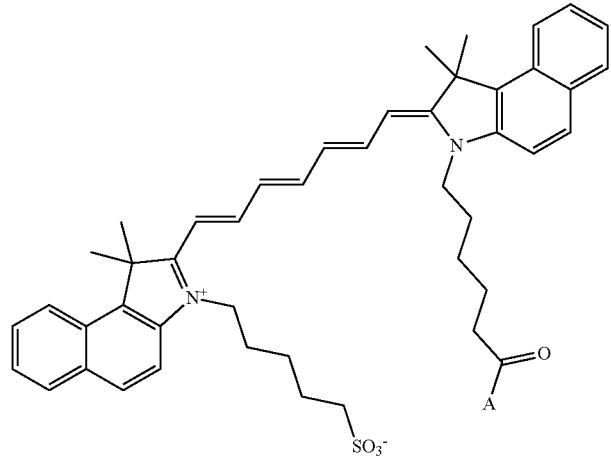 |
| 174 | 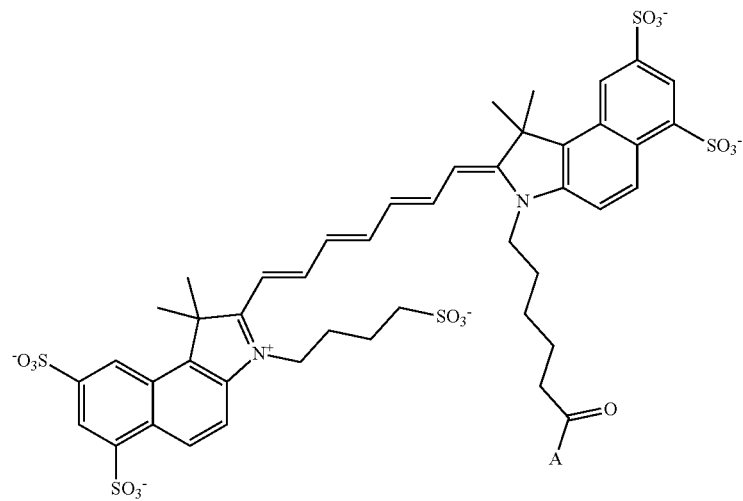 |
| 175 | 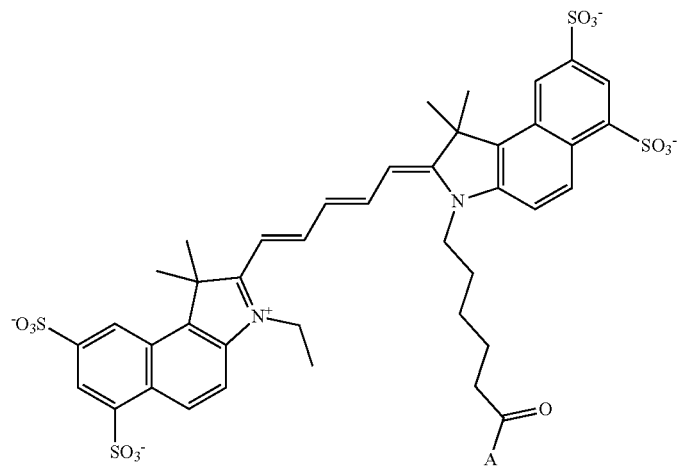 |

TABLE 4-continued

Exemplary compounds according to the present disclosure.
A = MCMPCFTTDHQMARRCDDCCGGAGRGKCYGPQCLCR (SEQ ID NO: 6) (attached at K-27)

| No. | Structure |
|---|---|
| 176 | 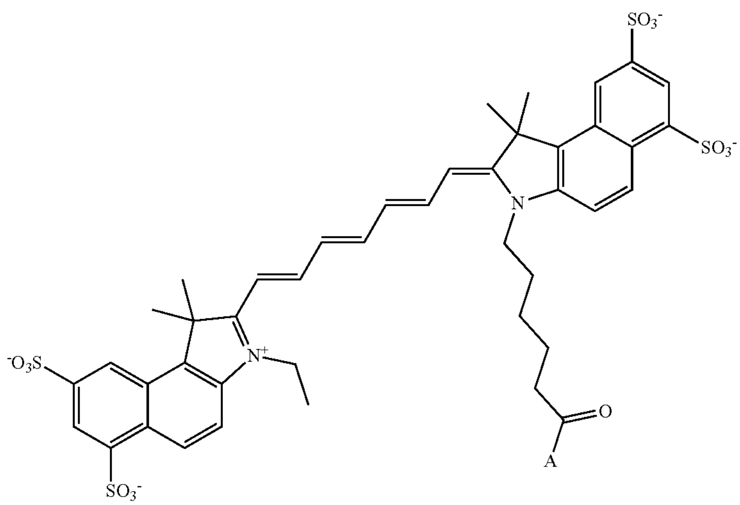 |
| 177 | 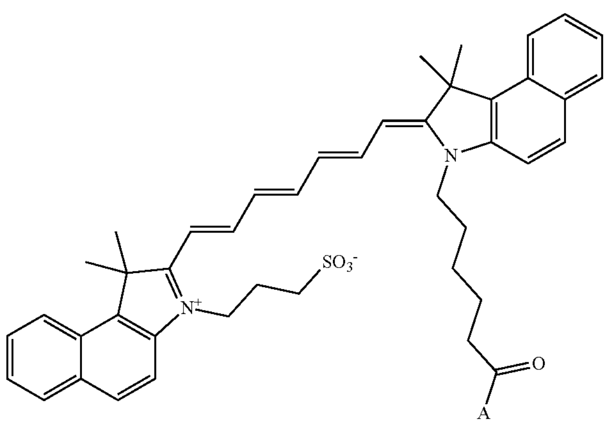 |
| 178 | 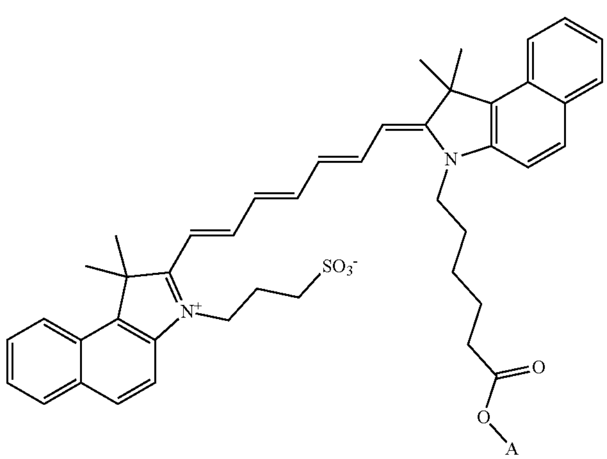 |

TABLE 4-continued
Exemplary compounds according to the present disclosure.
A = MCMPCFTTDHQMARRCDDCCGGAGRGKCYGPQCLCR (SEQ ID NO: 6) (attached at K-27)
| No. | Structure |
|---|---|
| 179 | 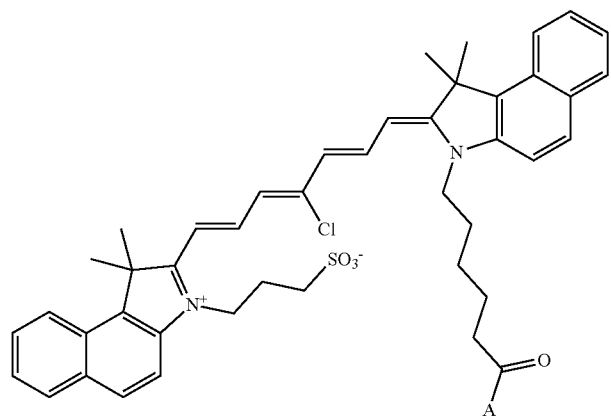 |
| 180 | 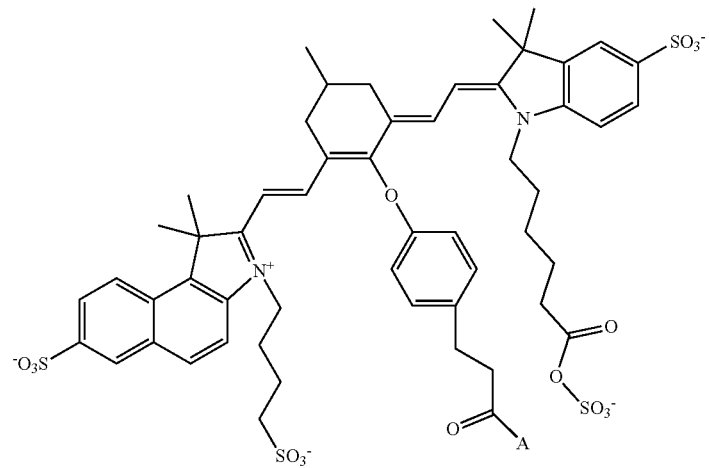 |

TABLE 5
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 181 | 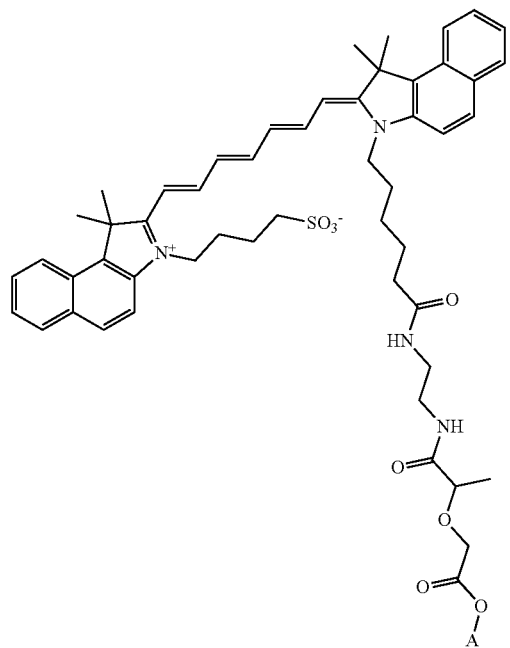 |
| 182 | 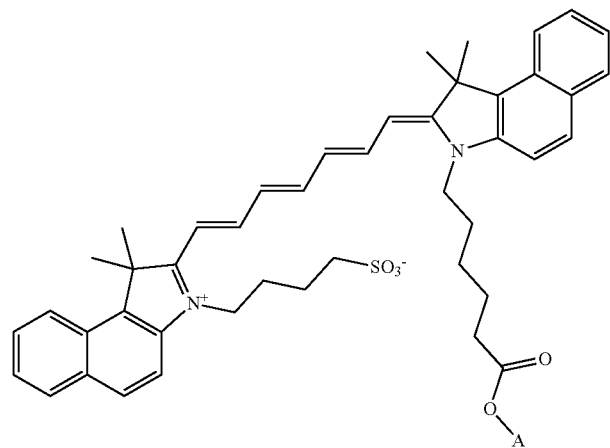 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 183 | 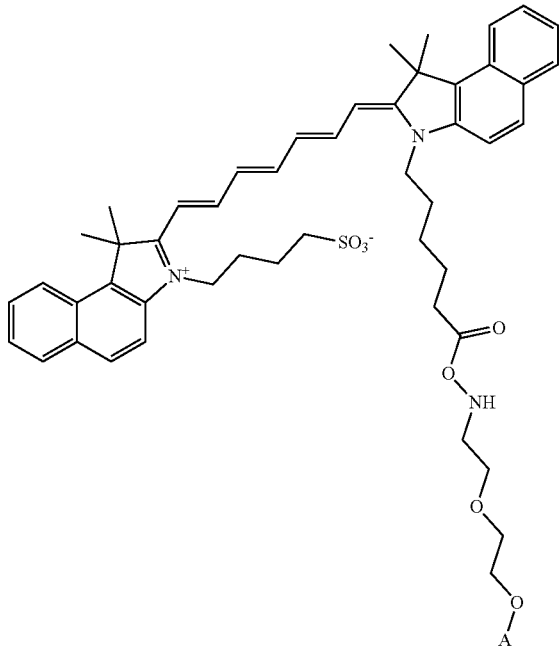 |
| 184 | 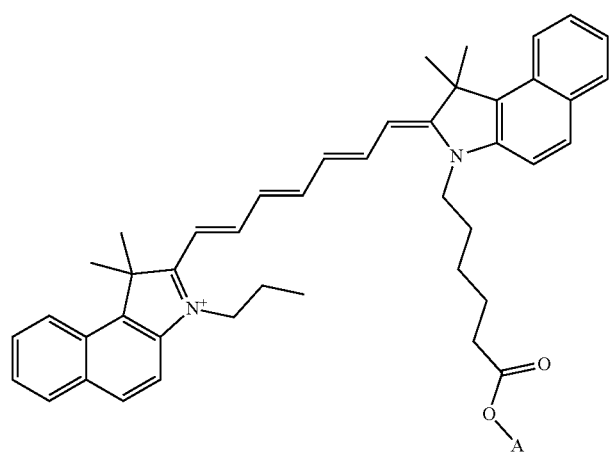 |
| 185 | 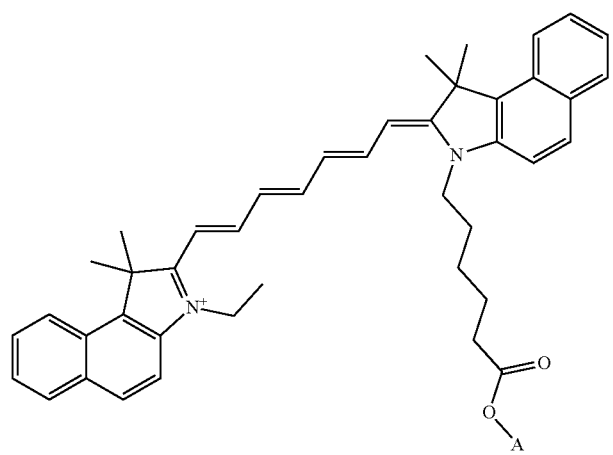 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 186 | 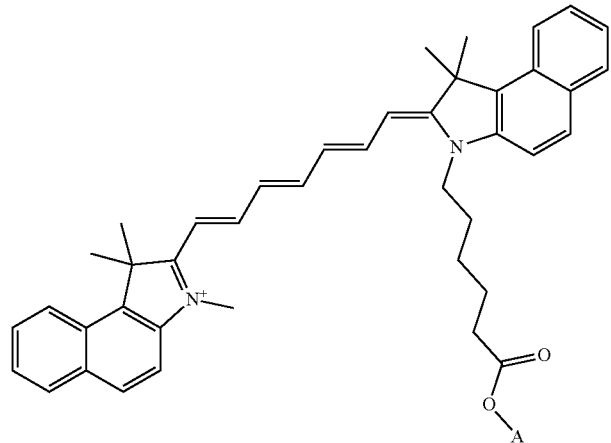 |
| 187 | 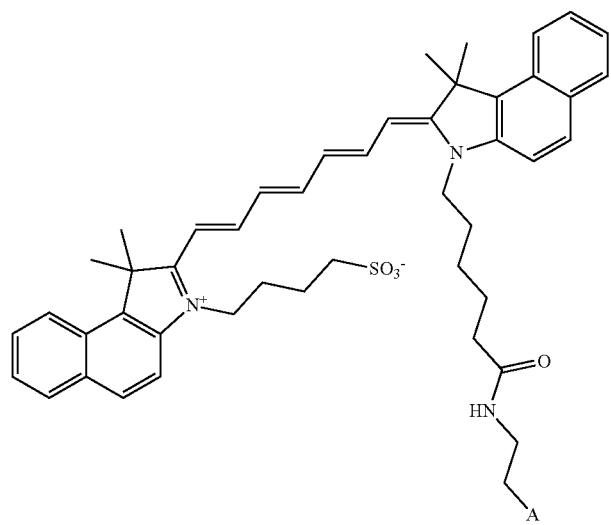 |
| 188 | 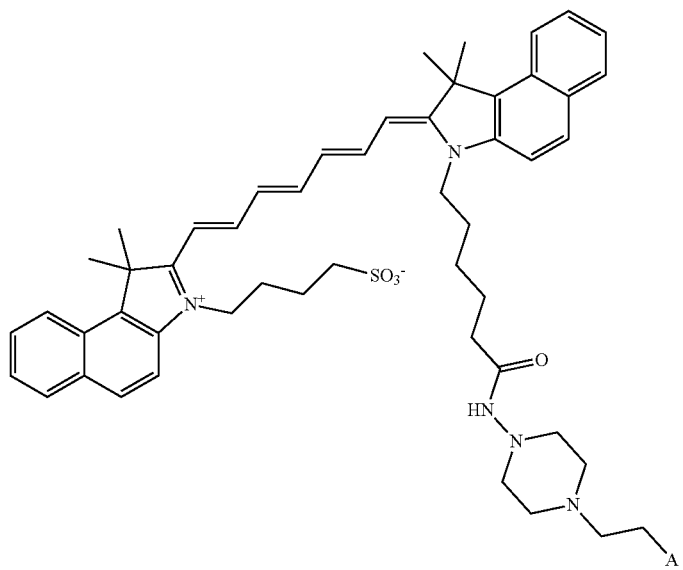 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 189 | 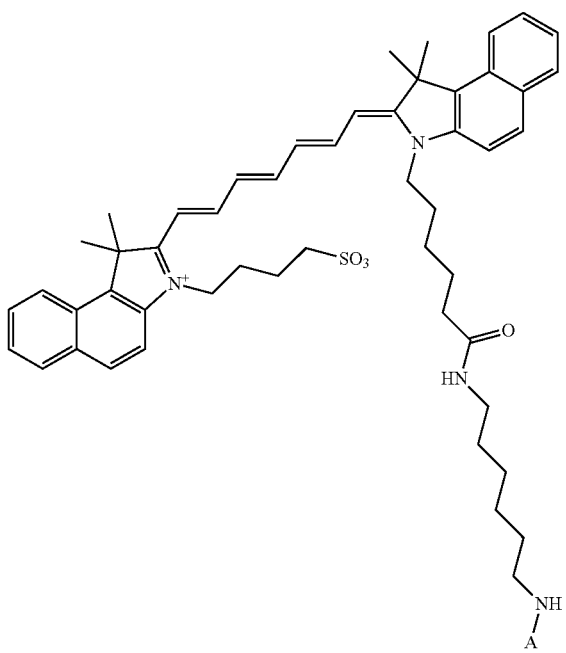 |
| 190 | 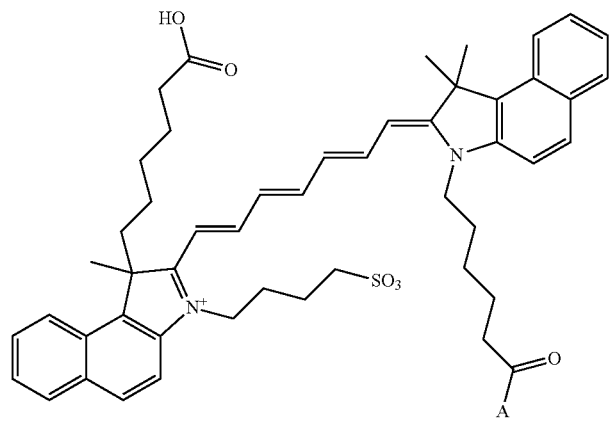 |
| 191 | 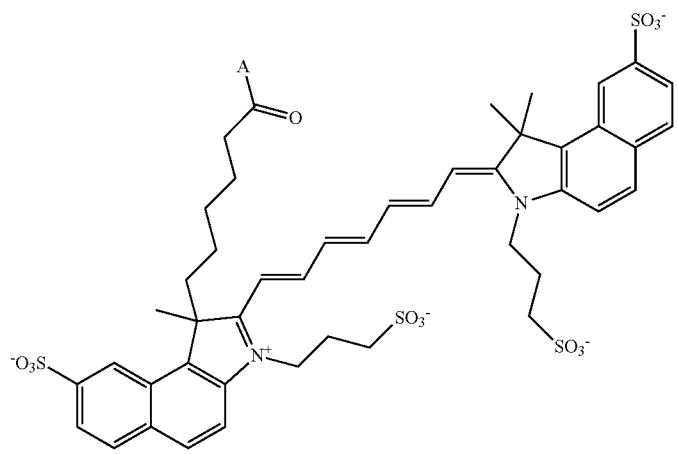 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 192 | 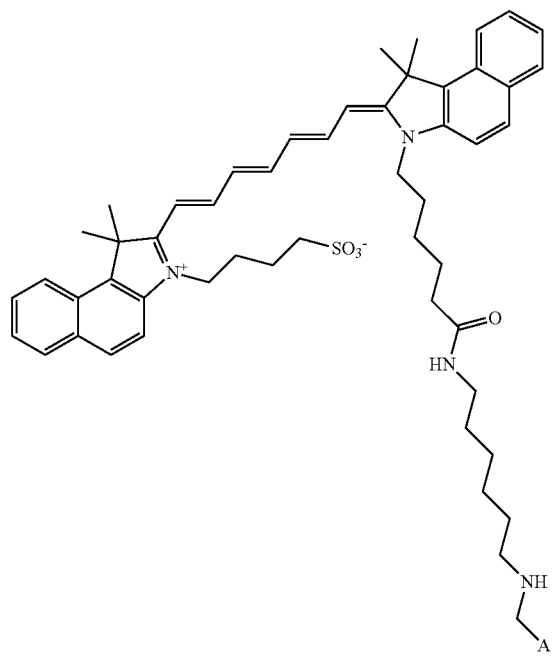 |
| 193 | 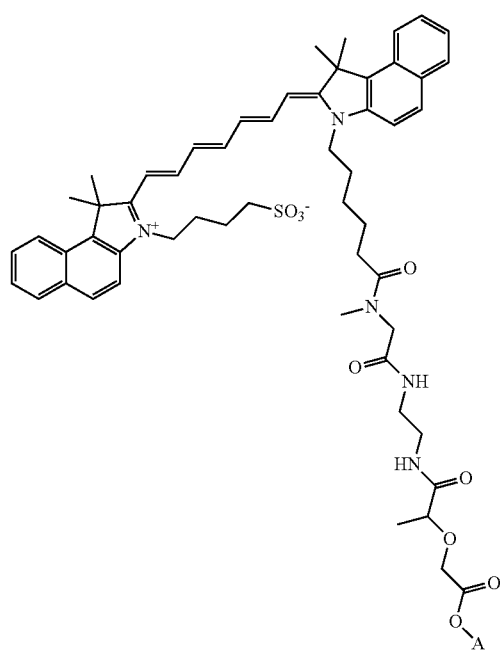 |

323 324
TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 194 | 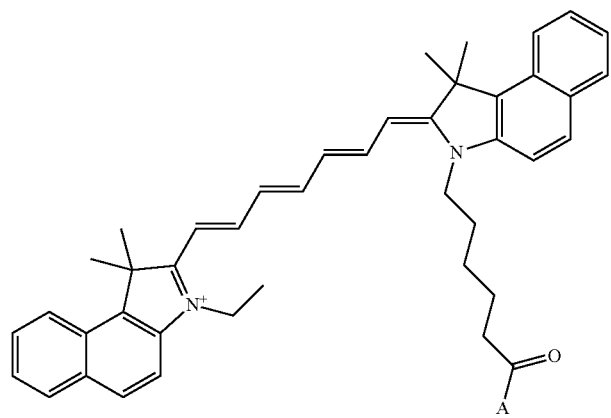 |
| 195 | 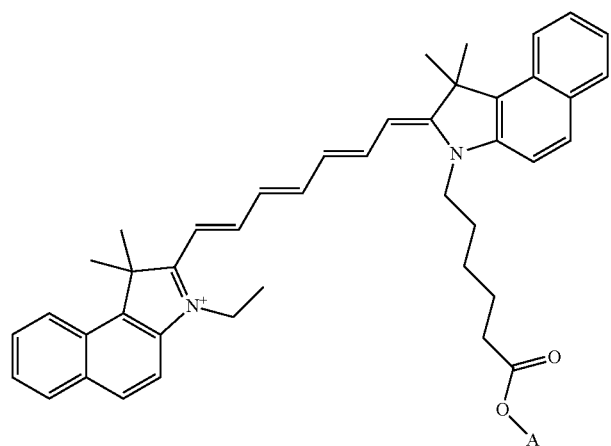 |
| 196 | 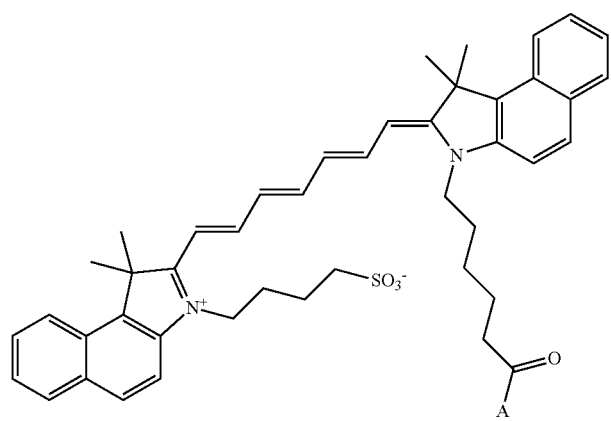 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|-----|-----------|
| 197 | 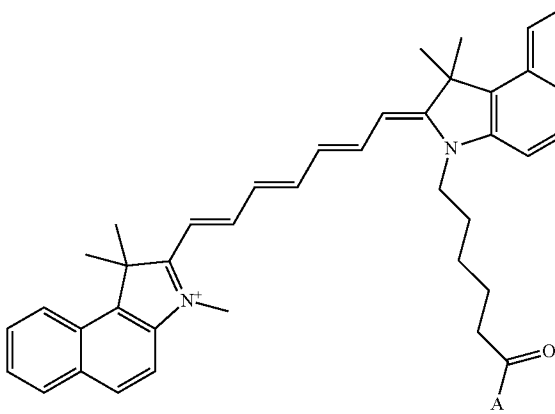 |
| 198 | 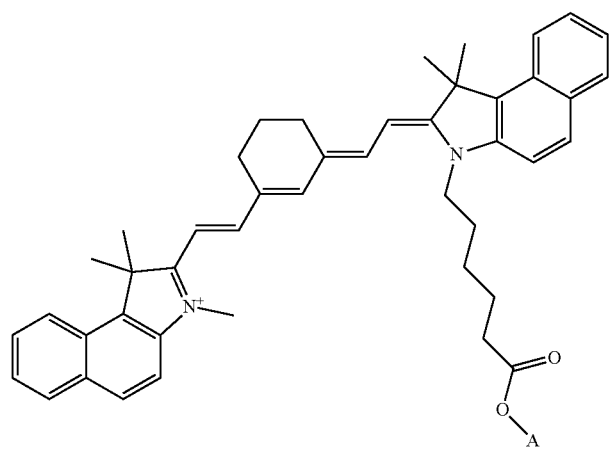 |
| 199 | 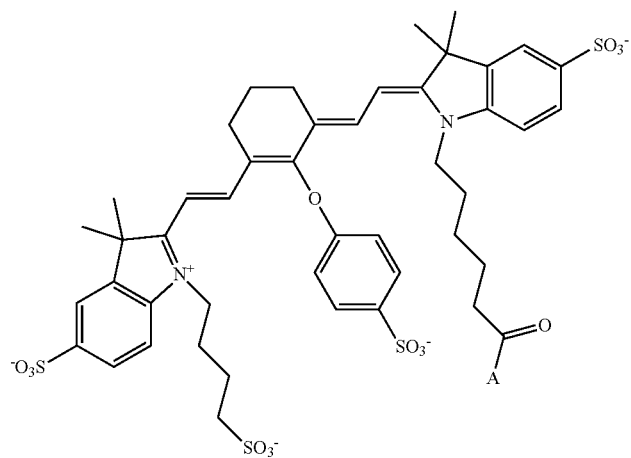 |

TABLE 5-continued

Exemplary compounds according to the present disclosure.
A = MCMPCFTTDHQMARACDDCCGGRGRGKCYGPQCLCR (SEQ ID NO: 8) (attached at K-27)

| No. | Structure |
| --- | --- |
| 200 | 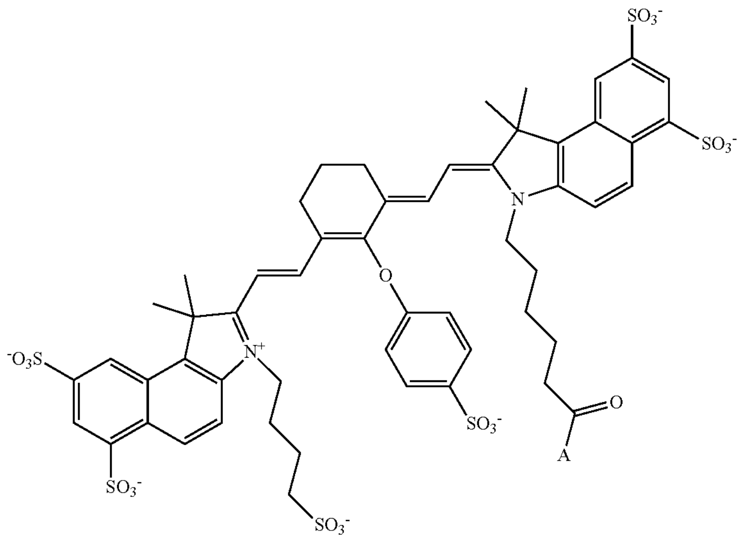 |
| 201 | 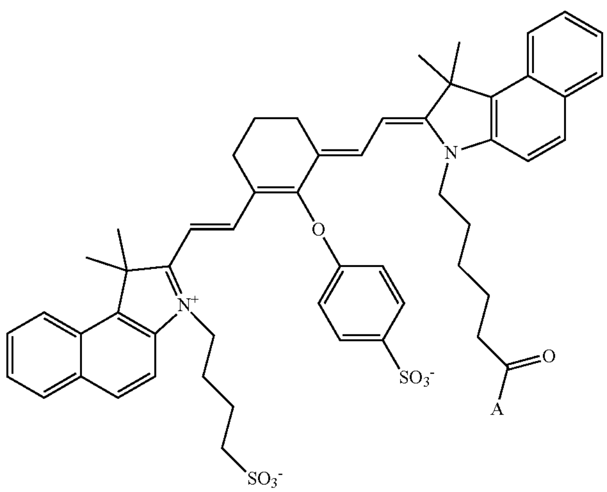 |
| 202 | 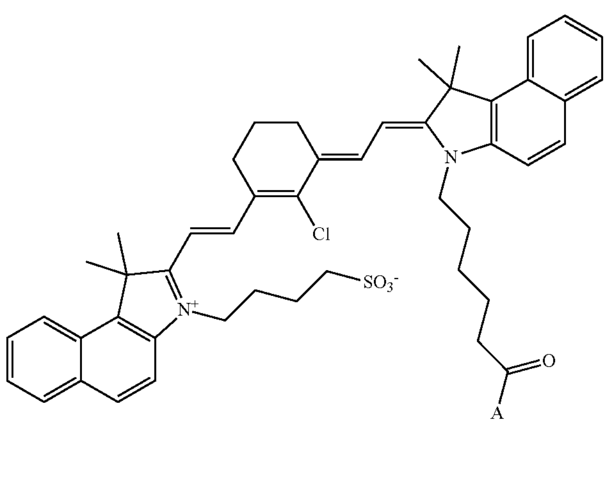 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 203 | 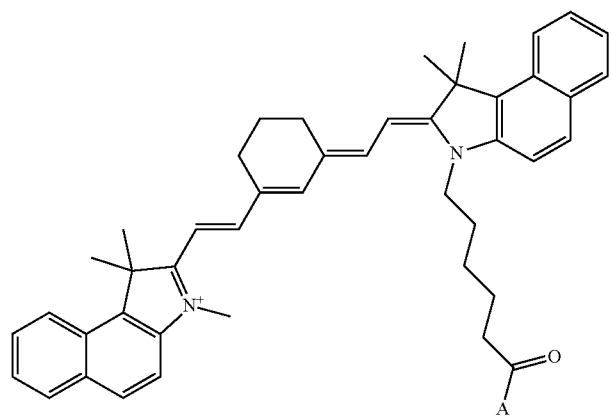 |
| 204 | 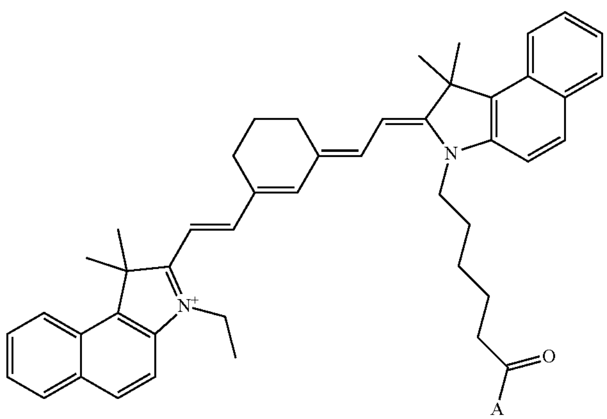 |
| 205 | 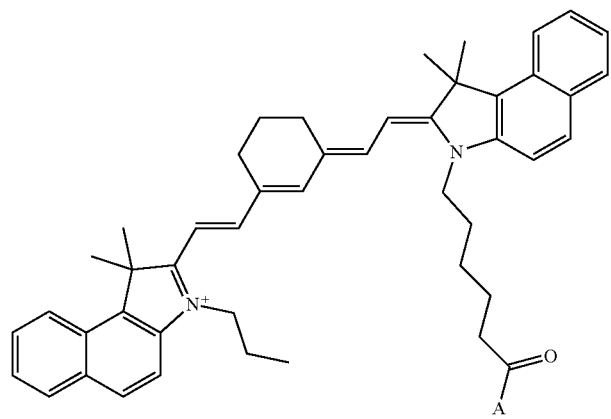 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 206 | 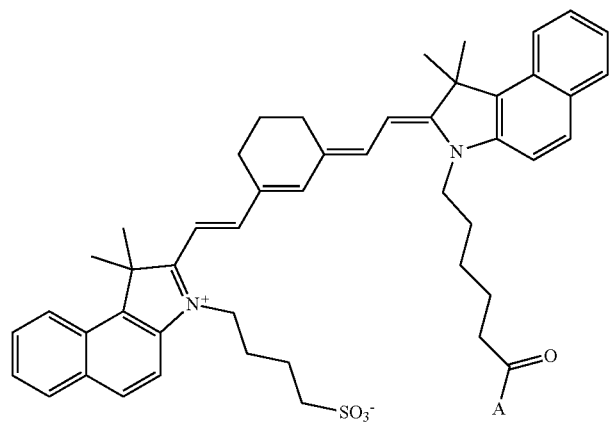 |
| 207 | 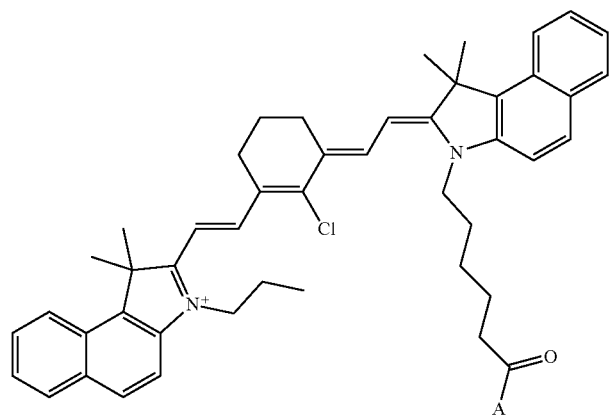 |
| 208 | 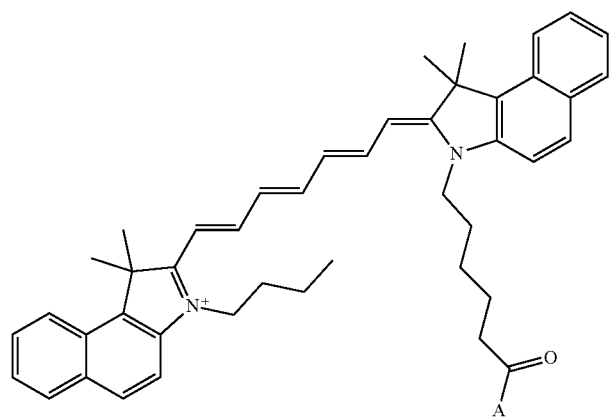 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 209 | 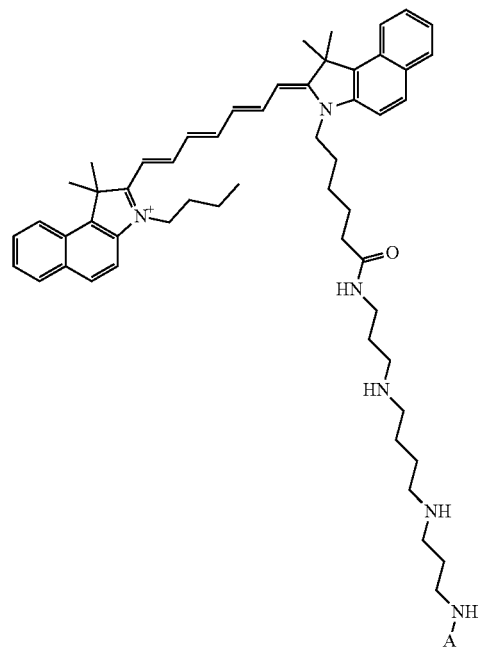 |
| 210 | 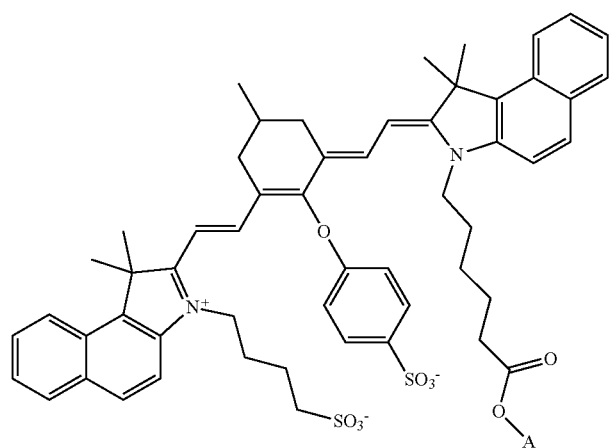 |
| 211 | 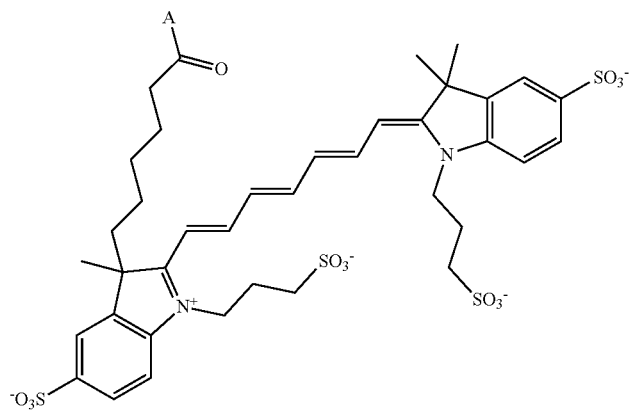 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|-----|-----------|
| 212 | 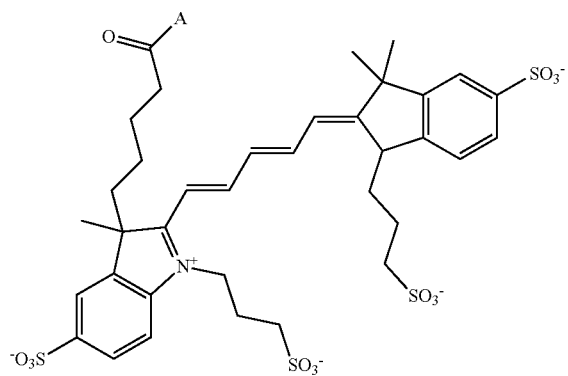 |
| 213 | 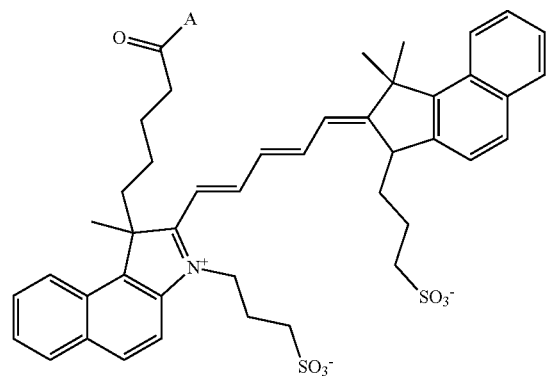 |
| 214 | 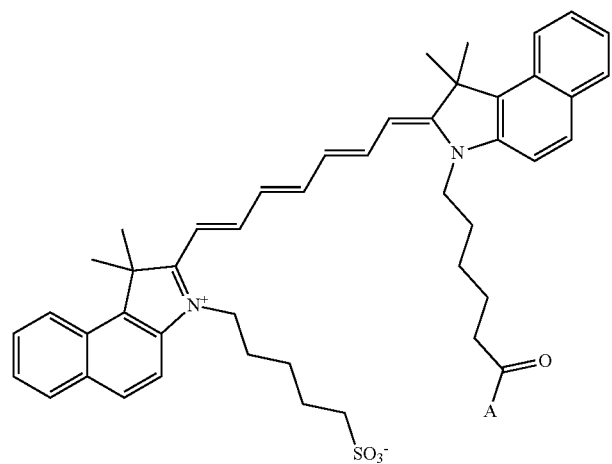 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 215 | 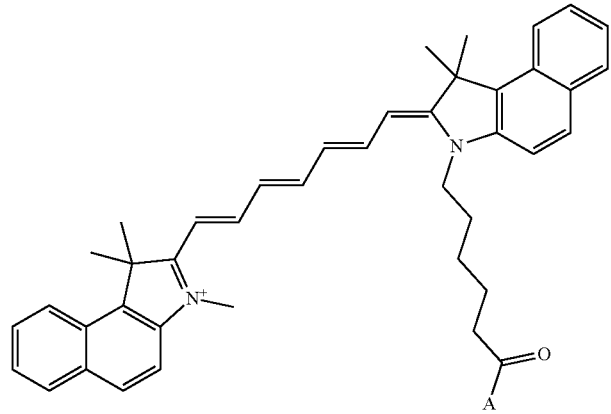 |
| 216 | 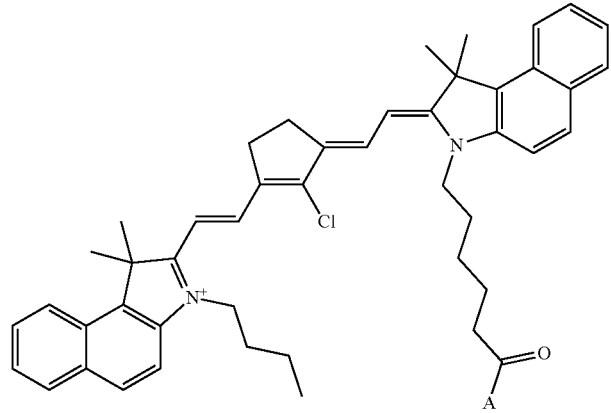 |
| 217 | 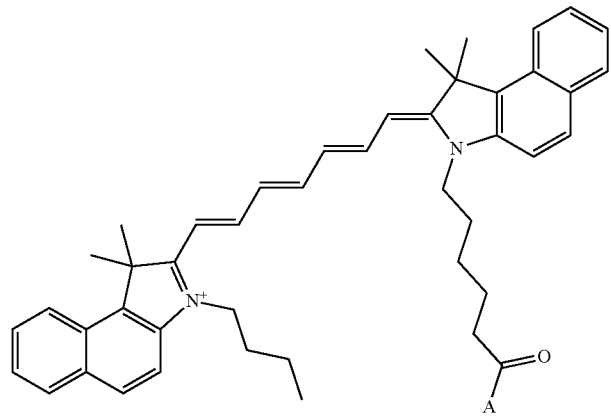 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 218 | 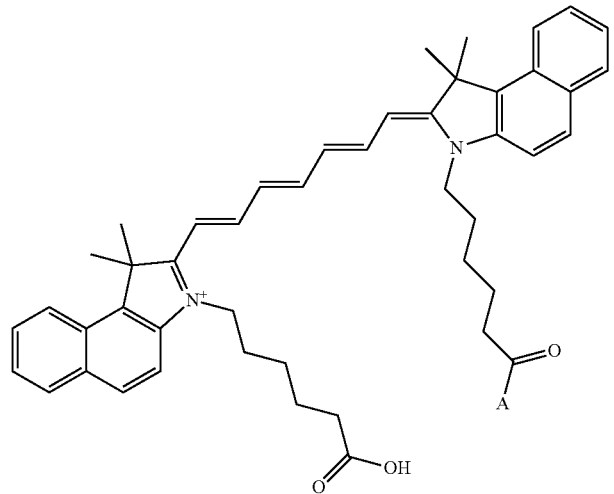 |
| 219 | 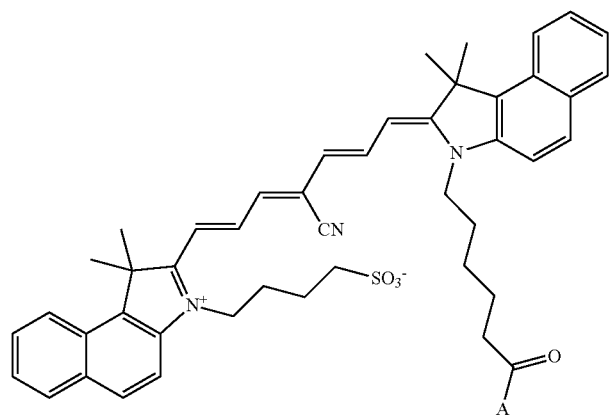 |
| 220 | 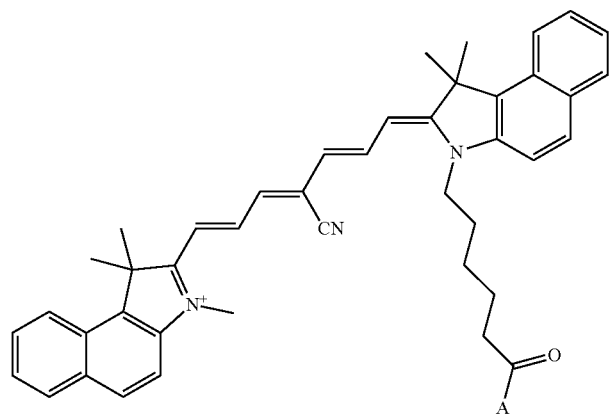 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 221 | 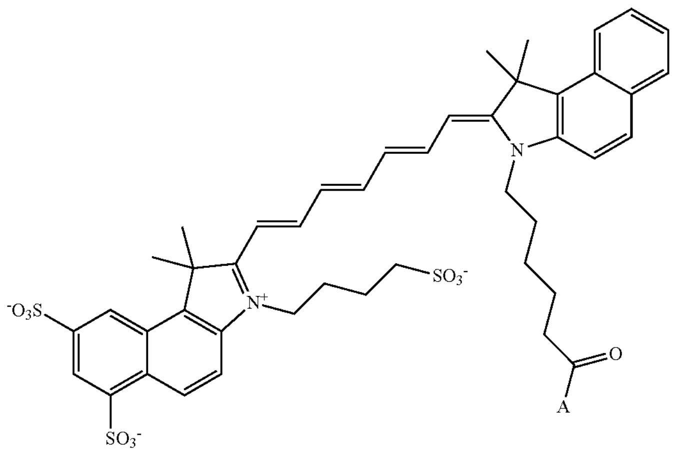 |
| 222 | 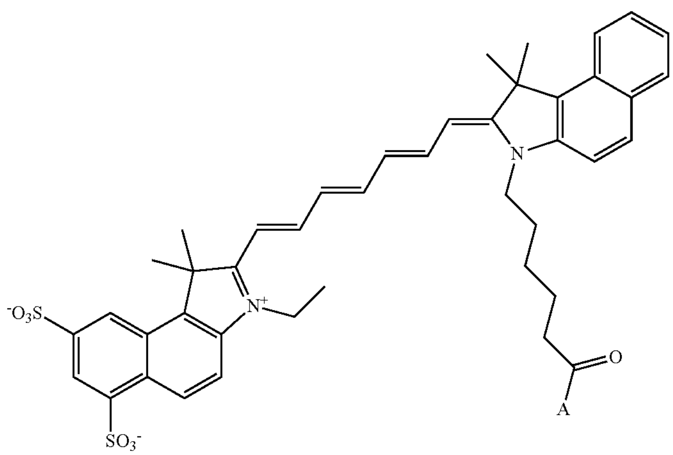 |
| 223 | 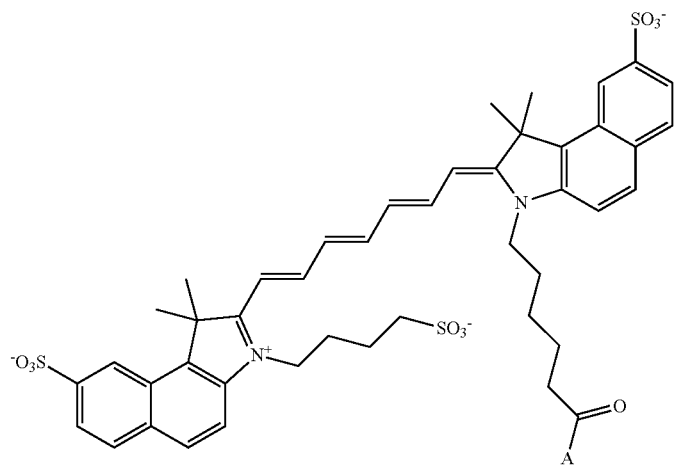 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 224 | 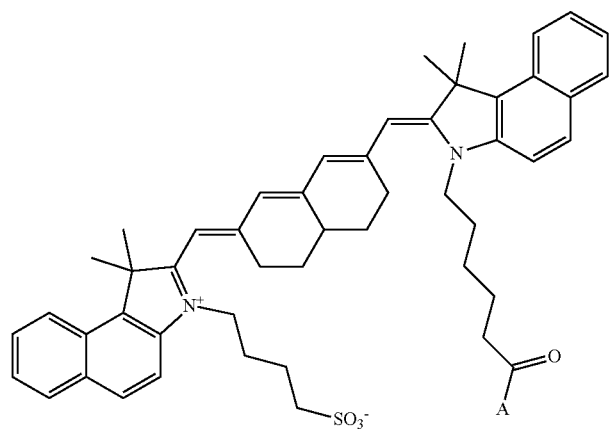 |
| 225 | 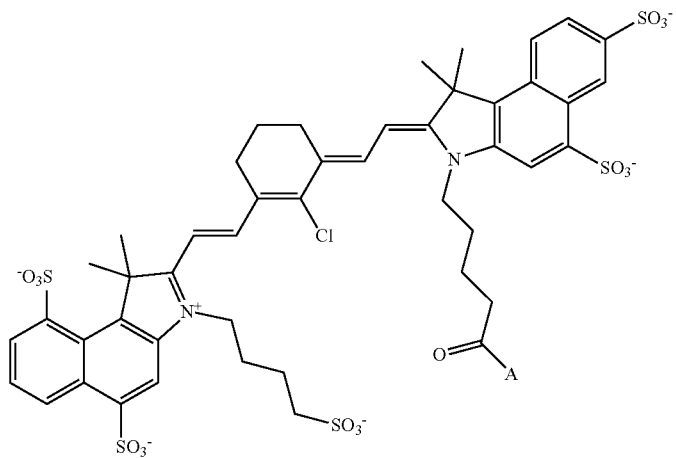 |
| 226 | 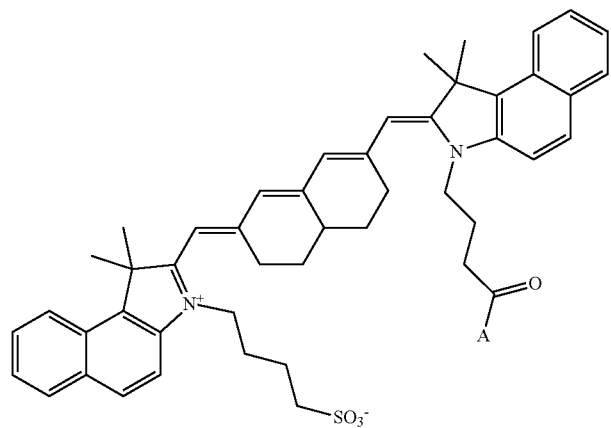 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 227 | 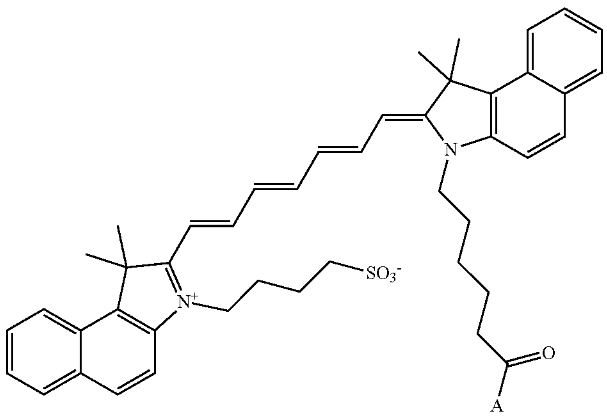 |
| 228 | 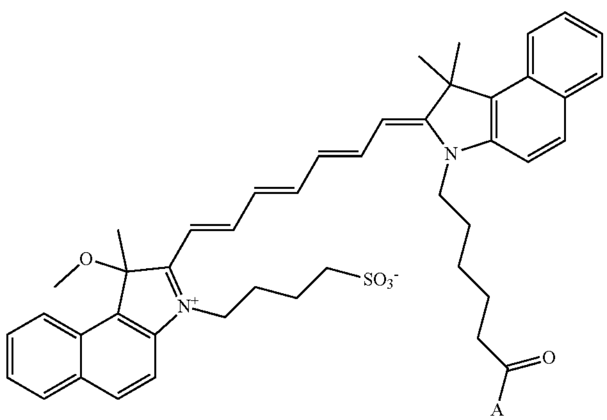 |
| 229 | 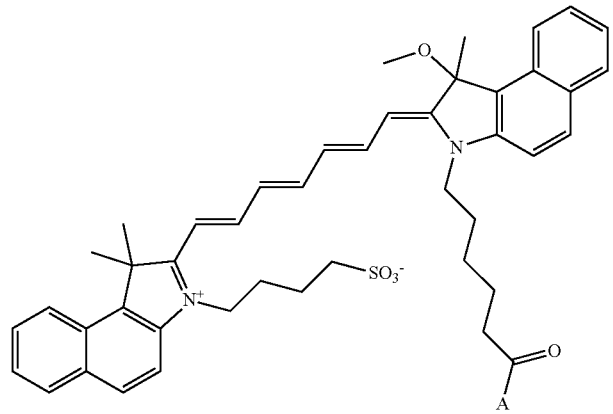 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 230 | 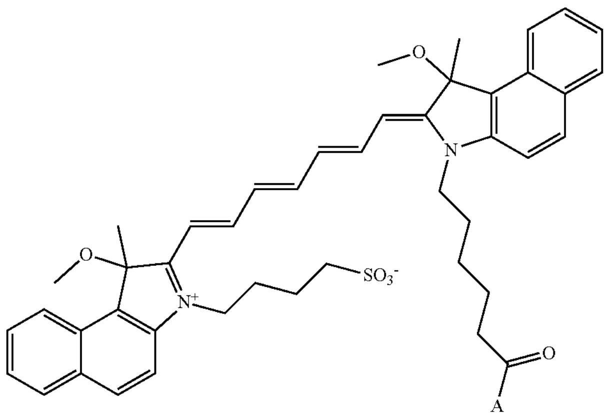 |
| 231 | 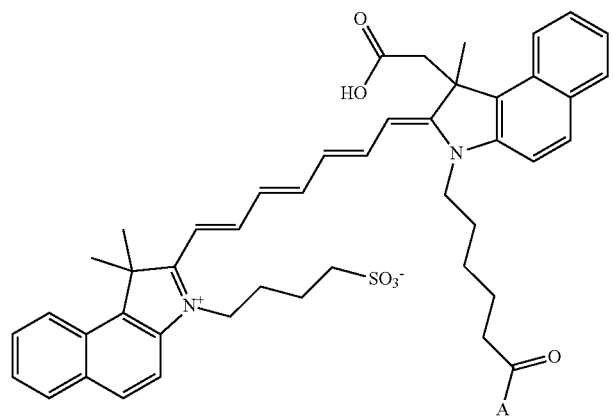 |
| 232 | 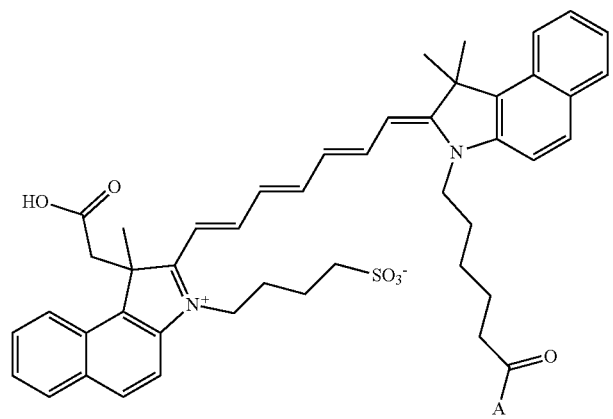 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|---|---|
| 233 | 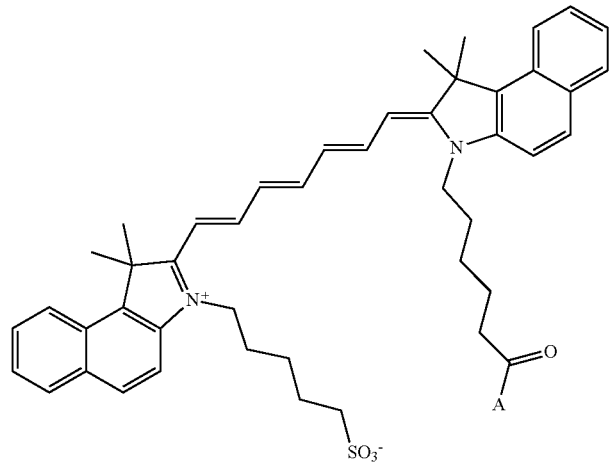 |
| 234 | 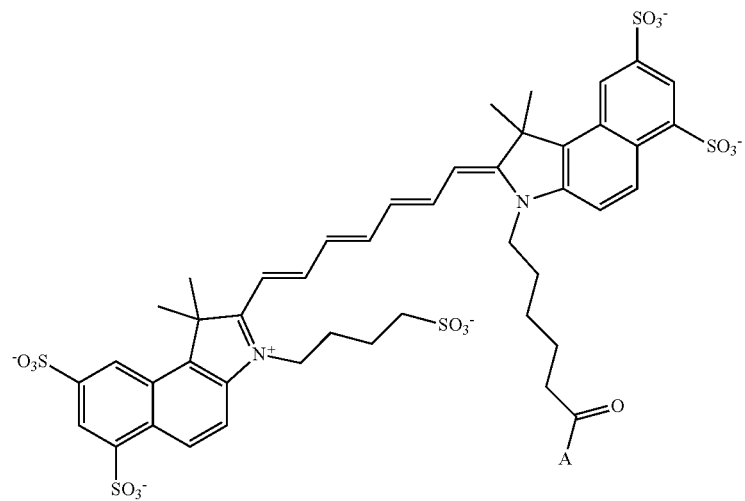 |
| 235 | 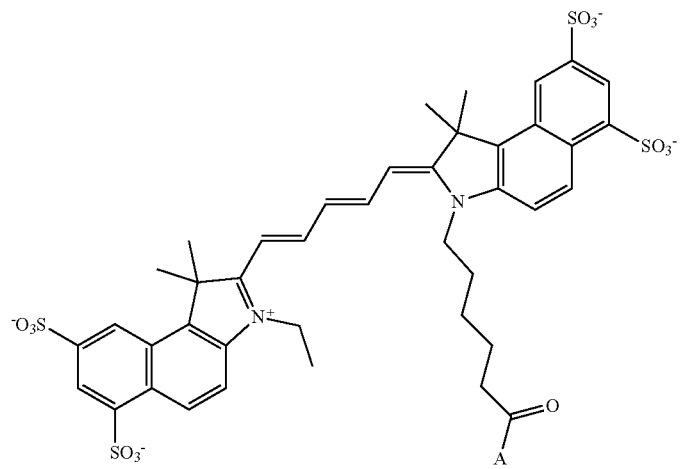 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
|-----|-----------|
| 236 | 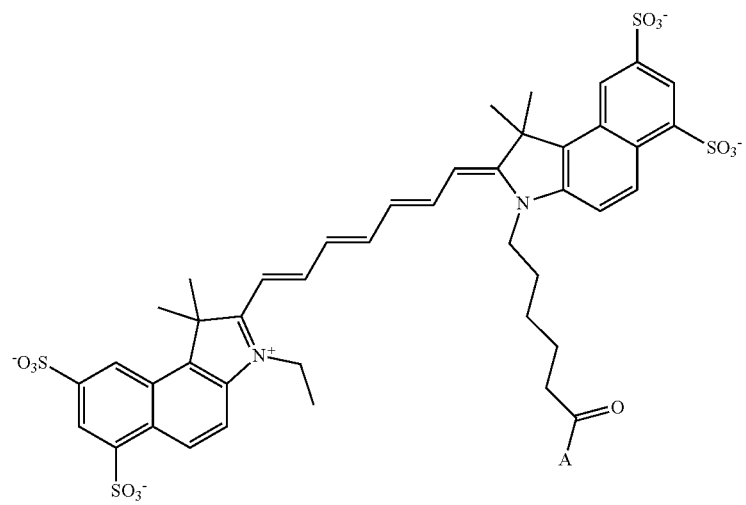 |
| 237 | 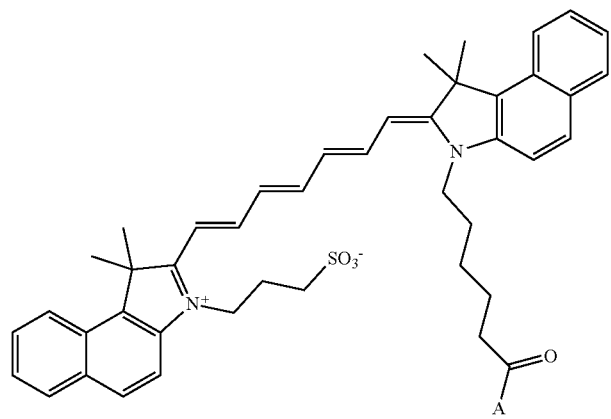 |
| 238 | 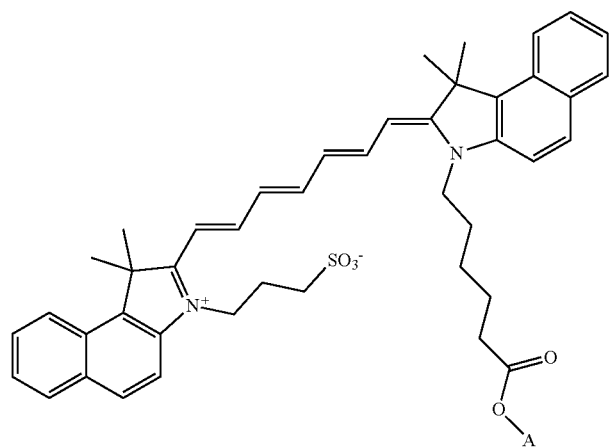 |

TABLE 5-continued
Exemplary compounds according to the present disclosure.
A = MCMPCFTTDHQMARACDDCCGGRGRGKCYGPQCLCR (SEQ ID NO: 8) (attached at K-27)
| No. | Structure |
| --- | --- |
| 239 | 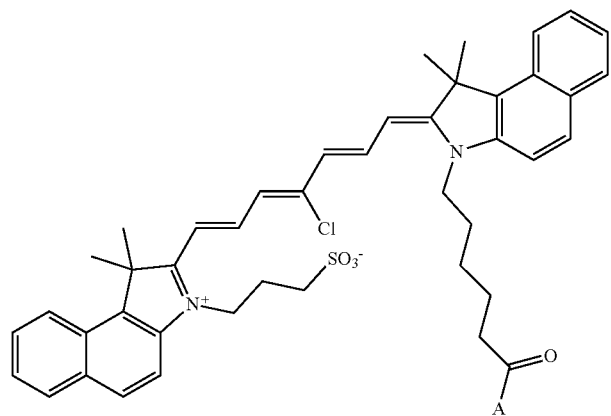 |
| 240 | 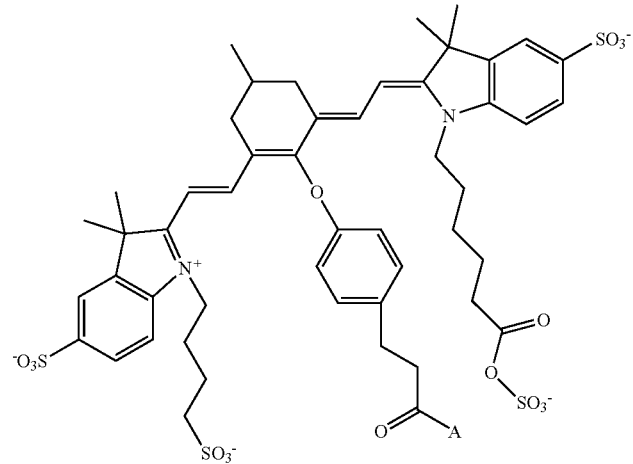 |

TABLE 6
Exemplary compounds according to the present disclosure.
No. Structure
241
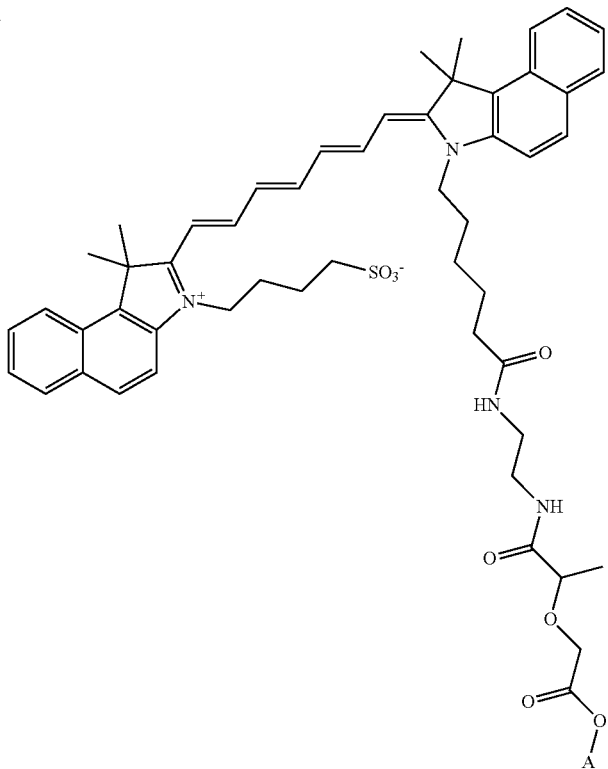
242
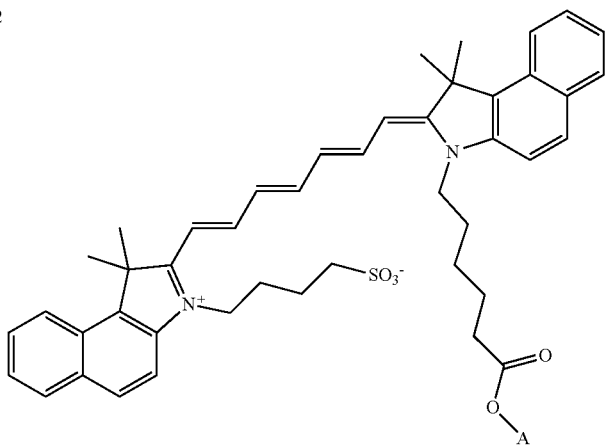

US 11,559,580 B1
357                                                                                            358
TABLE 6-continued
Exemplary compounds according to the present disclosure.
No. Structure
243
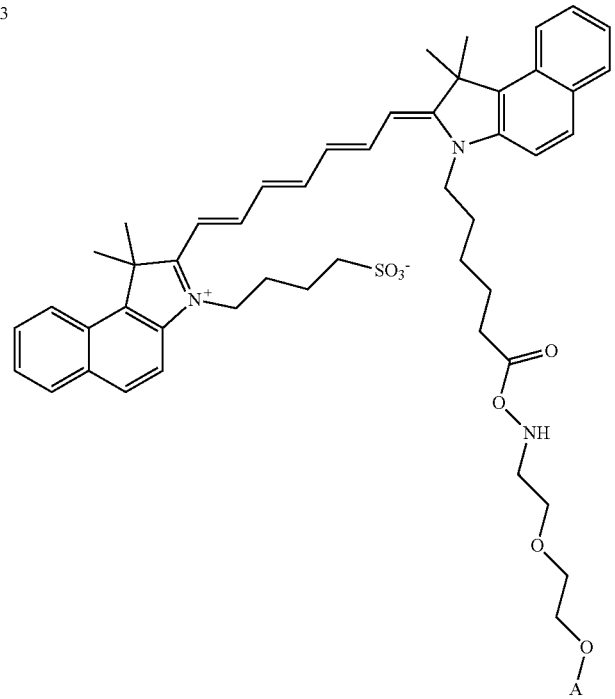
244
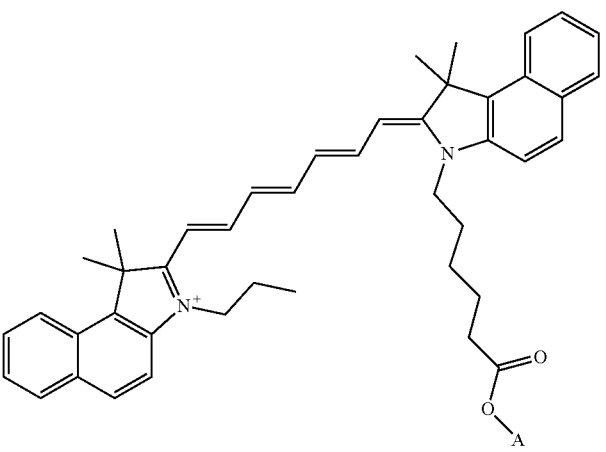
245
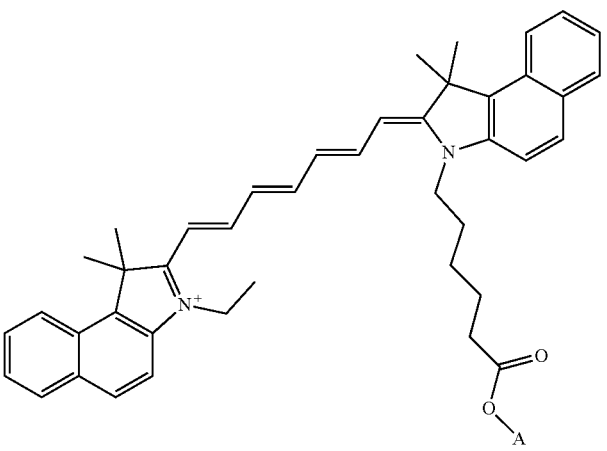

TABLE 6-continued
Exemplary compounds according to the present disclosure.
No. Structure
246
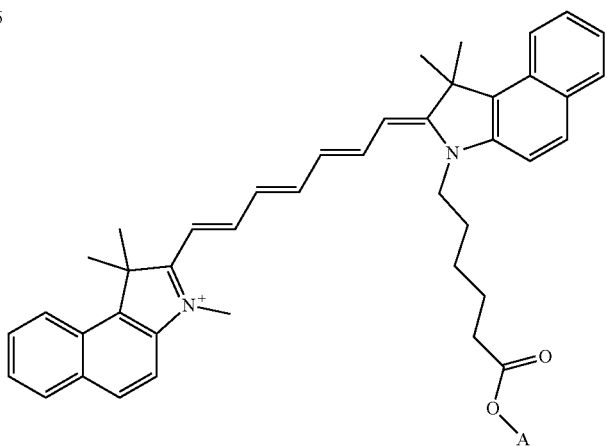
247
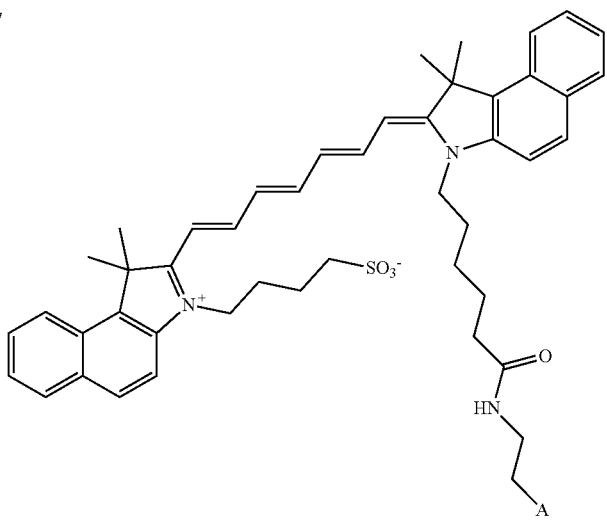
248
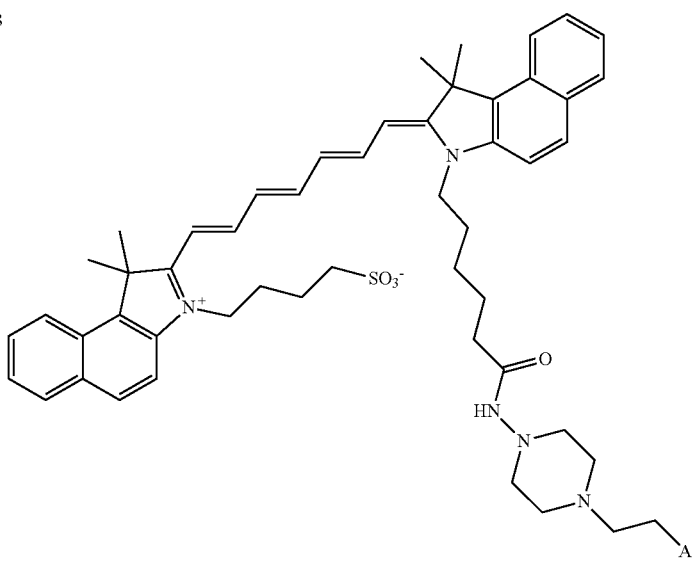

TABLE 6-continued
Exemplary compounds according to the present disclosure.
No. Structure
249
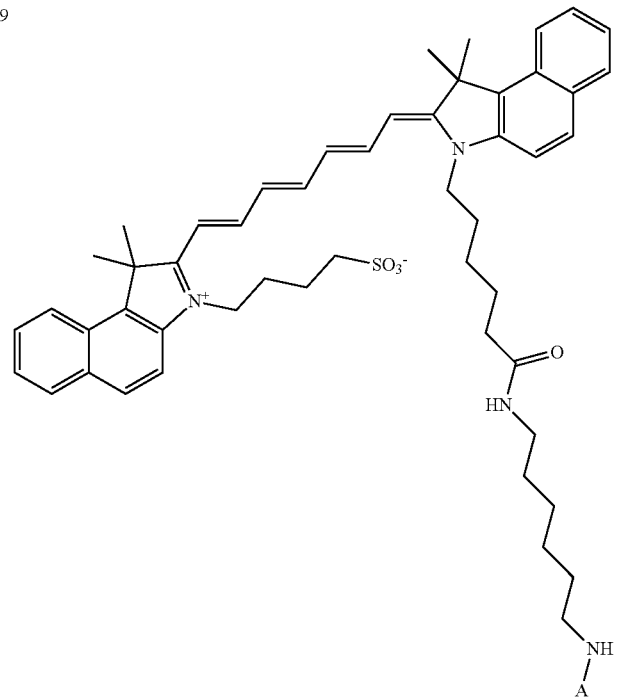
250
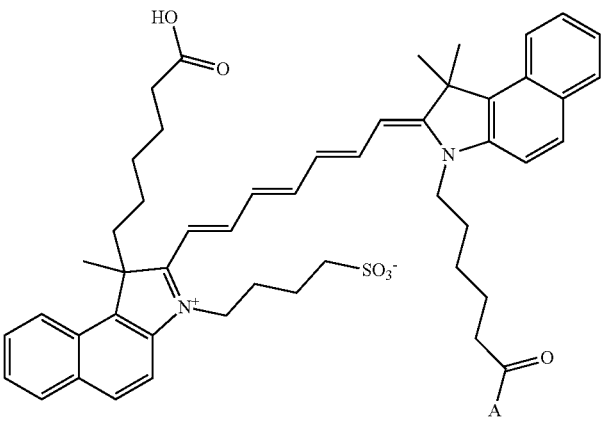
251
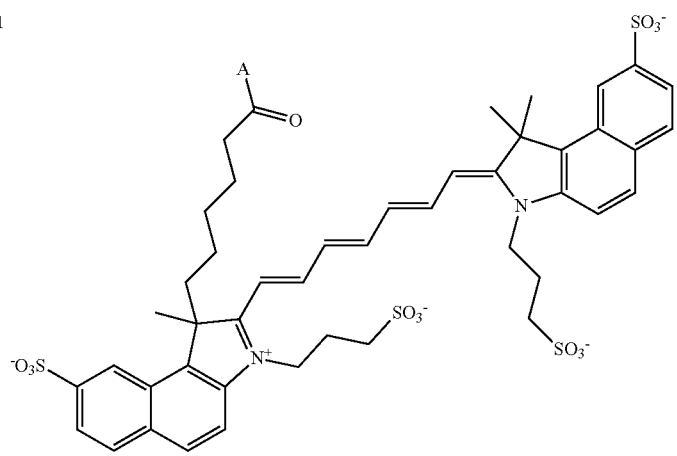

TABLE 6-continued
Exemplary compounds according to the present disclosure.
No. Structure
252 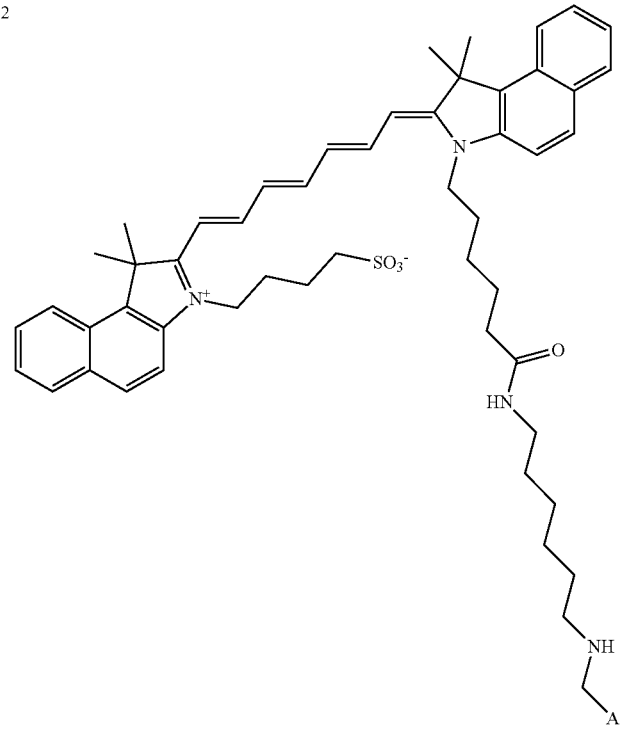
253 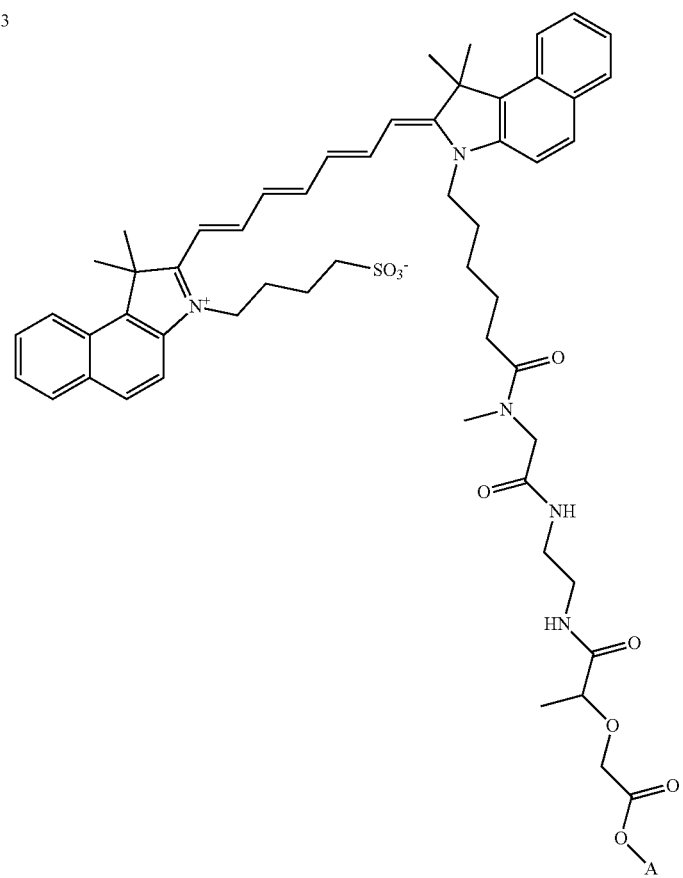

TABLE 6-continued
Exemplary compounds according to the present disclosure.
No. Structure
254
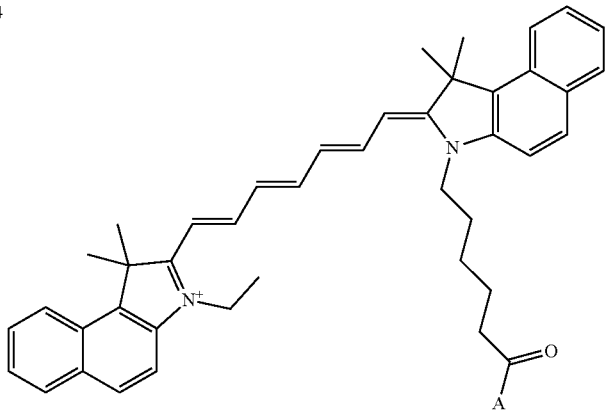
255
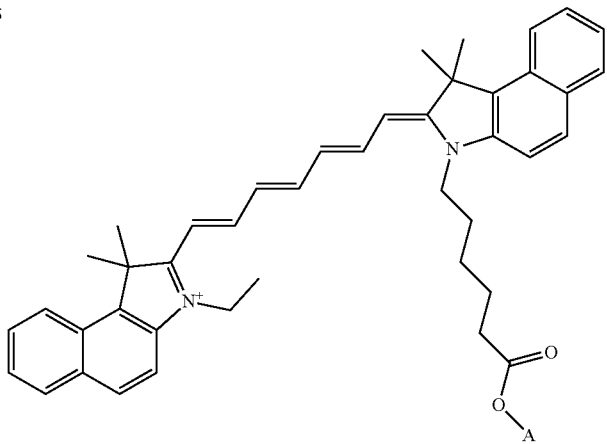
256
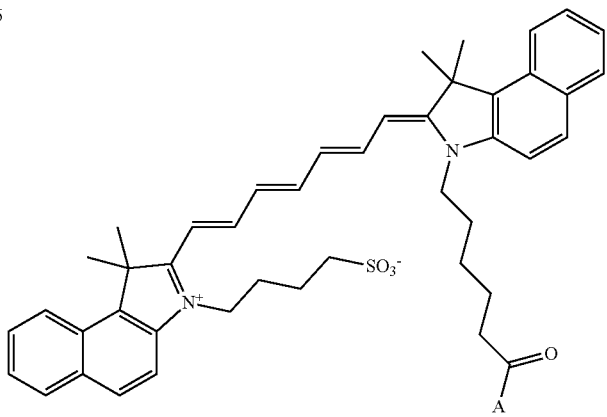

TABLE 6-continued
Exemplary compounds according to the present disclosure.
No. Structure
257
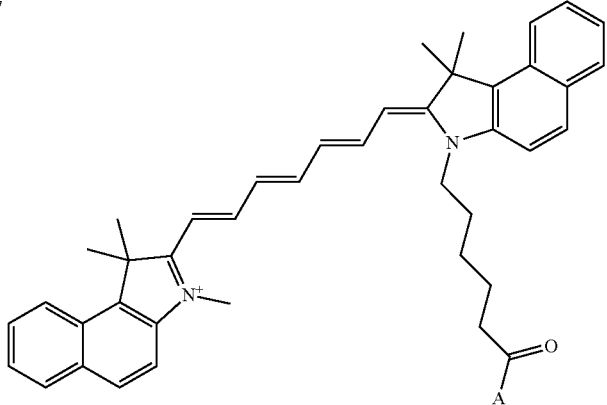
258
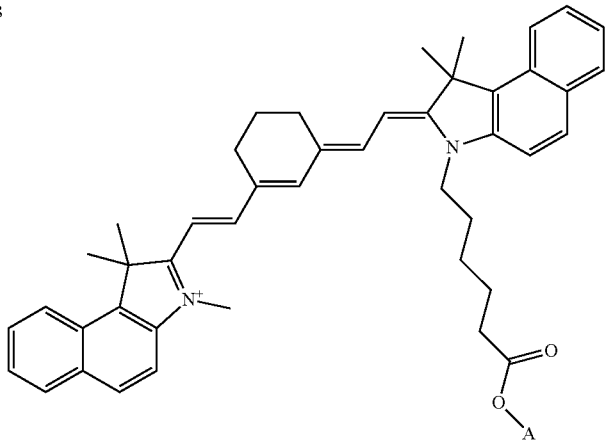
259
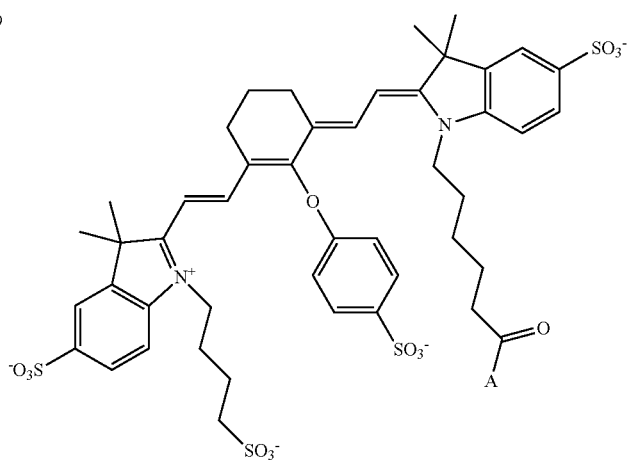

TABLE 6-continued
Exemplary compounds according to the present disclosure.
No. Structure
260 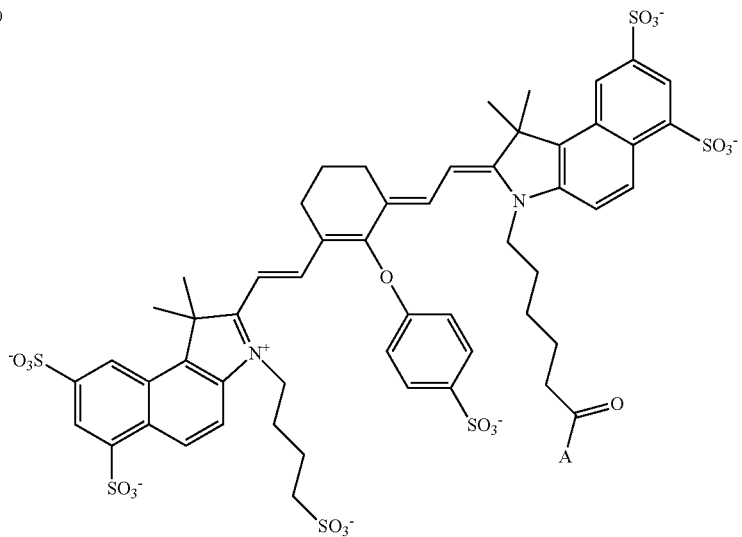
261 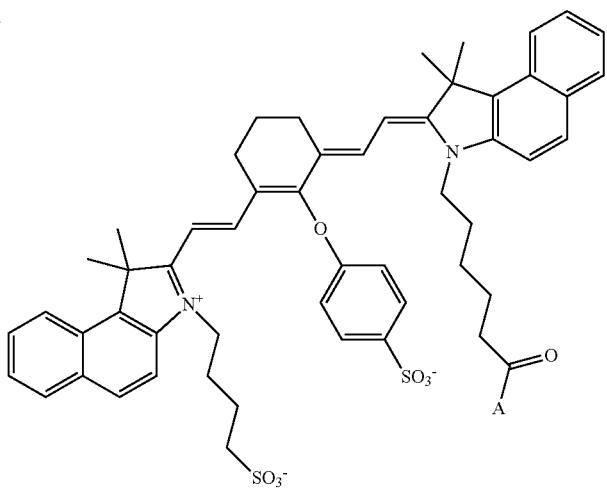
262 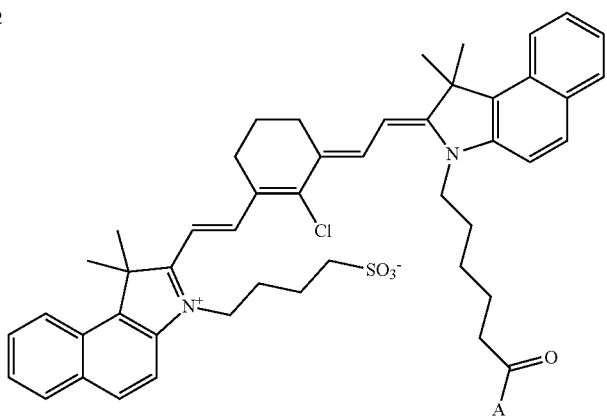

TABLE 6-continued
Exemplary compounds according to the present disclosure.
No. Structure
263
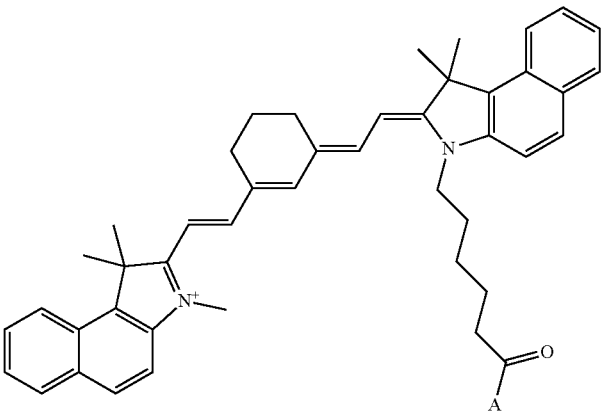
264
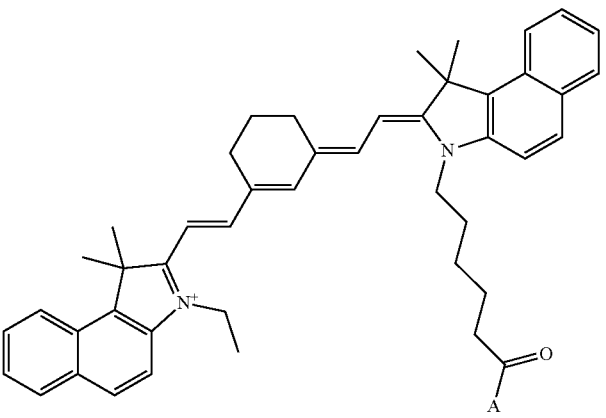
265
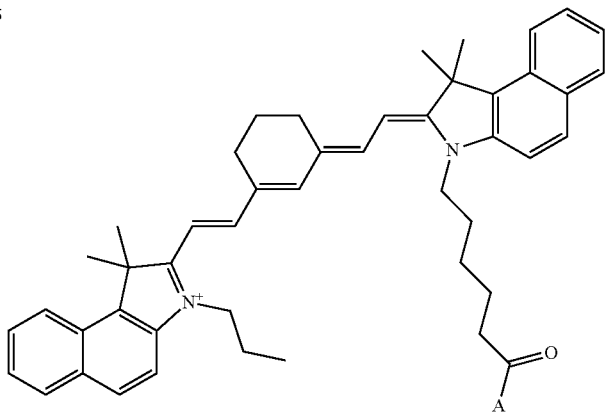

TABLE 6-continued
Exemplary compounds according to the present disclosure.
No. Structure
266
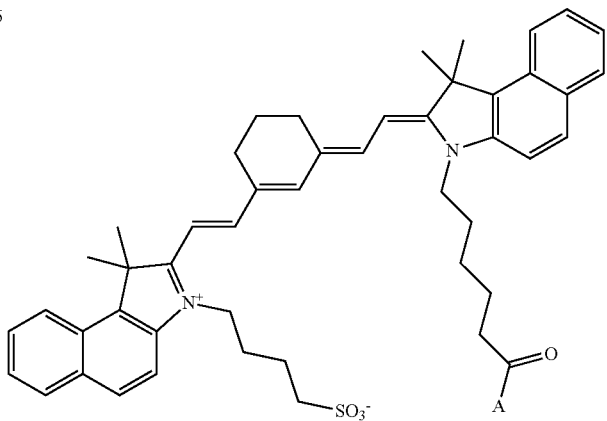
267
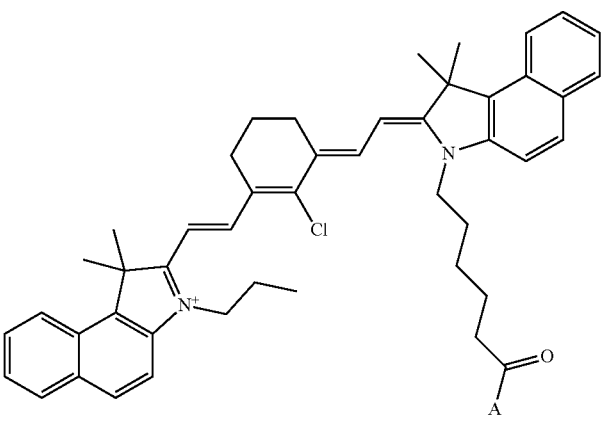
268
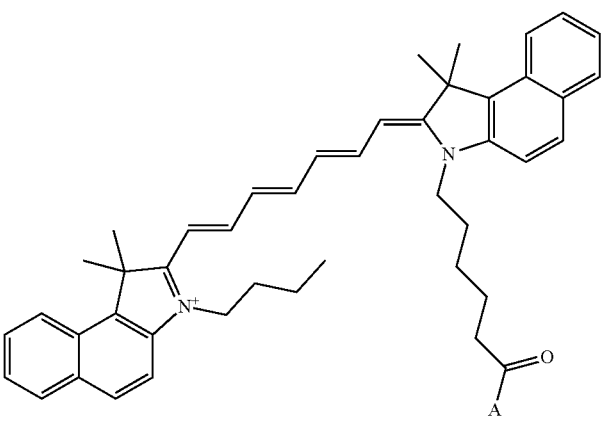

TABLE 6-continued
Exemplary compounds according to the present disclosure.
No. Structure
269 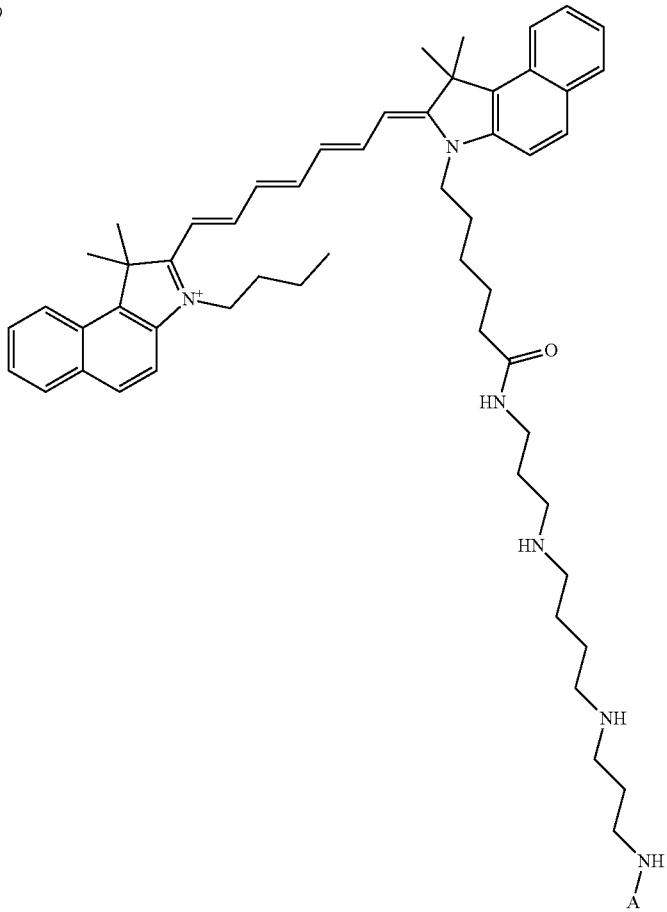
270 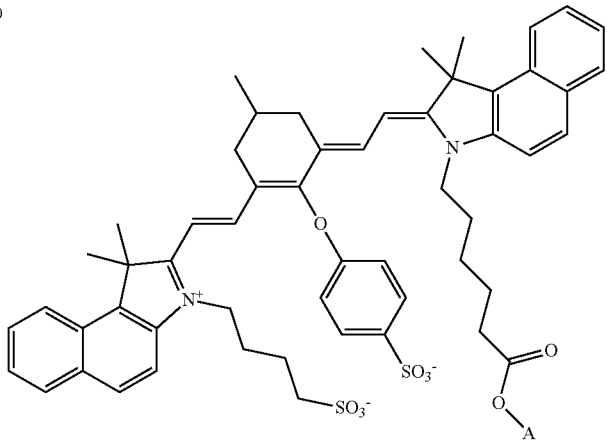

TABLE 6-continued
Exemplary compounds according to the present disclosure.
No. Structure
271 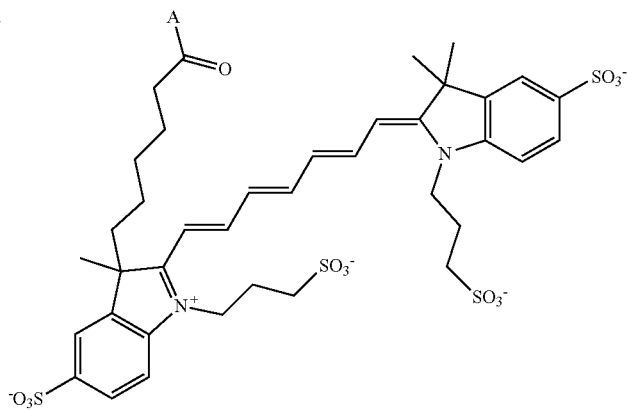
272 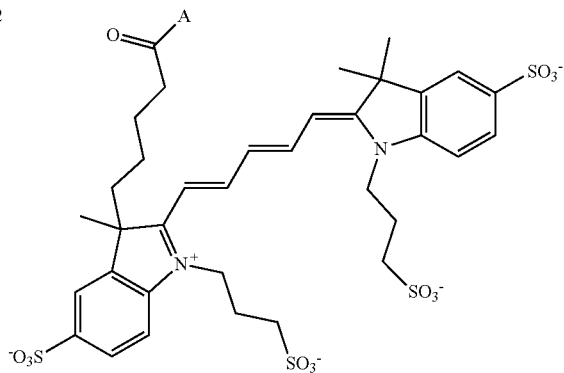
273 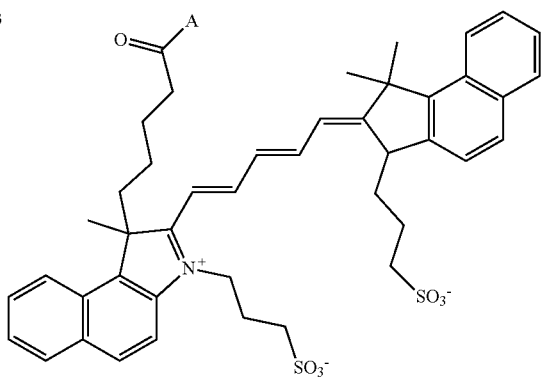

TABLE 6-continued
Exemplary compounds according to the present disclosure.
No. Structure
274
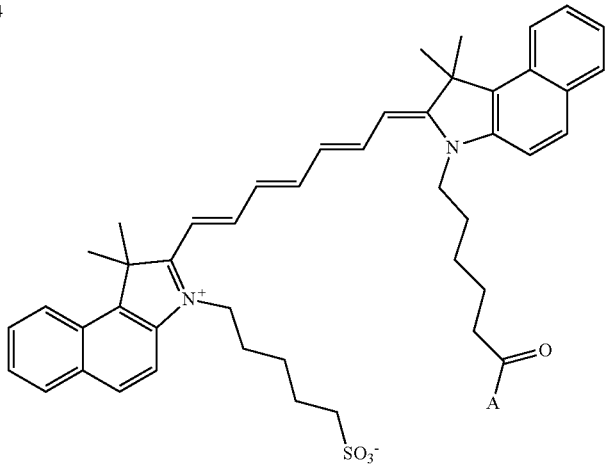
275
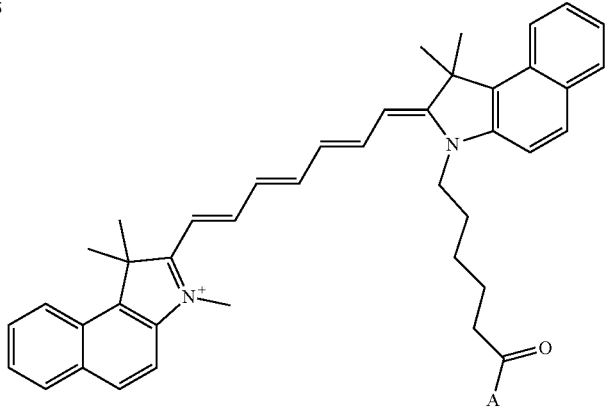
276
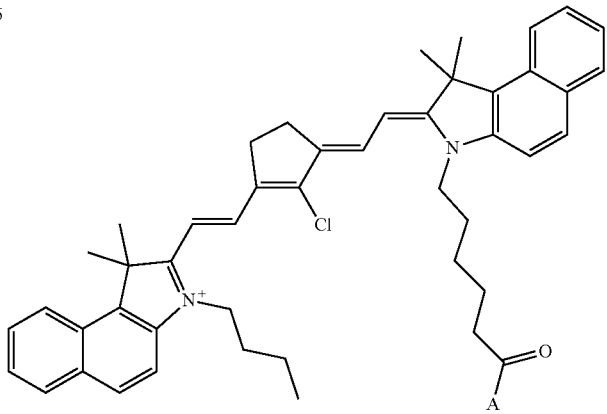

381
382
TABLE 6-continued
Exemplary compounds according to the present disclosure.
No. Structure
277
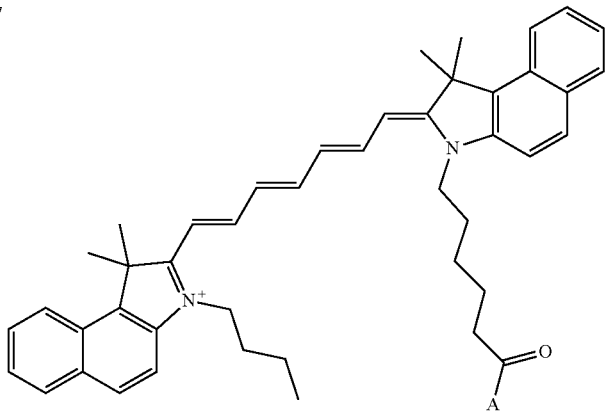
278
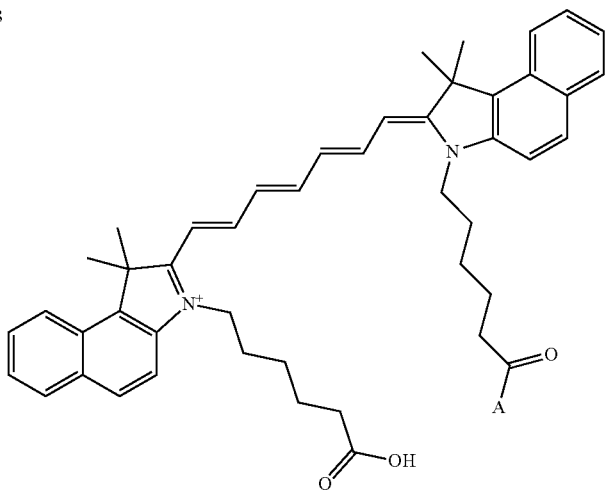
279
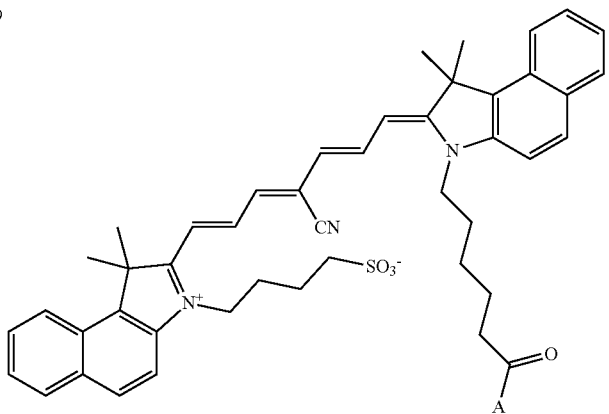

TABLE 6-continued
Exemplary compounds according to the present disclosure.
No. Structure
280
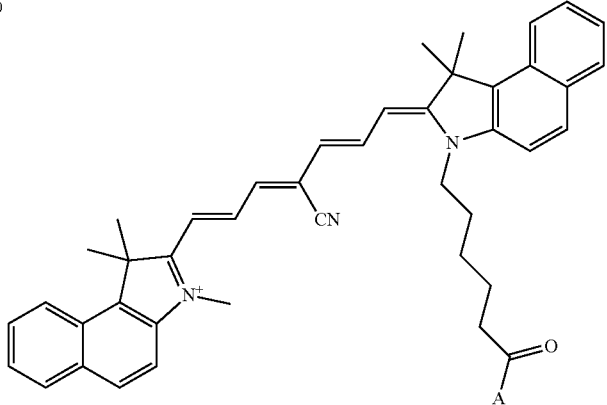
281
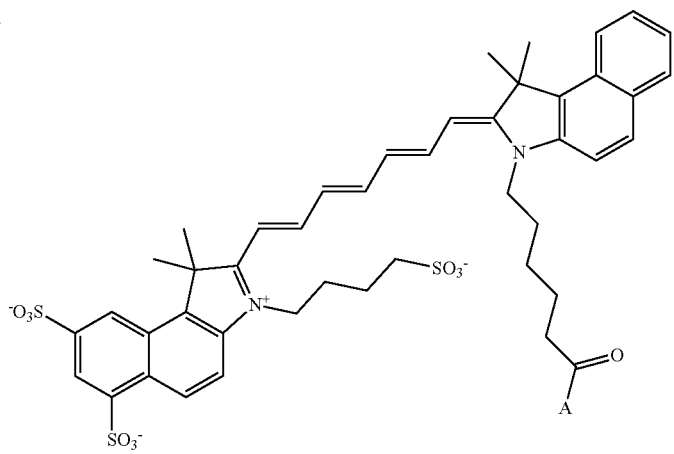
282
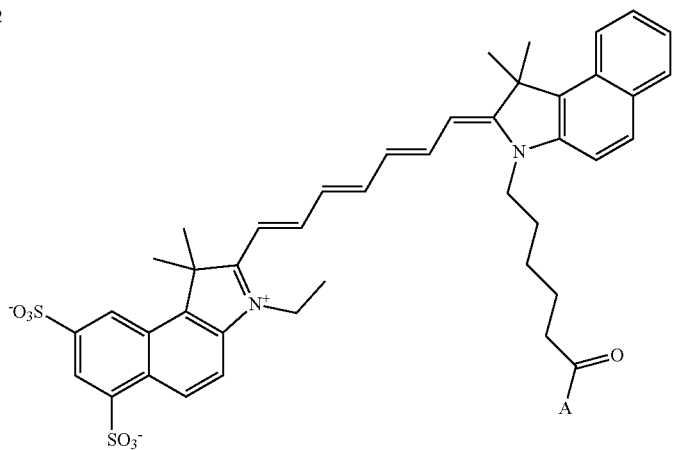

TABLE 6-continued
Exemplary compounds according to the present disclosure.
No. Structure
283
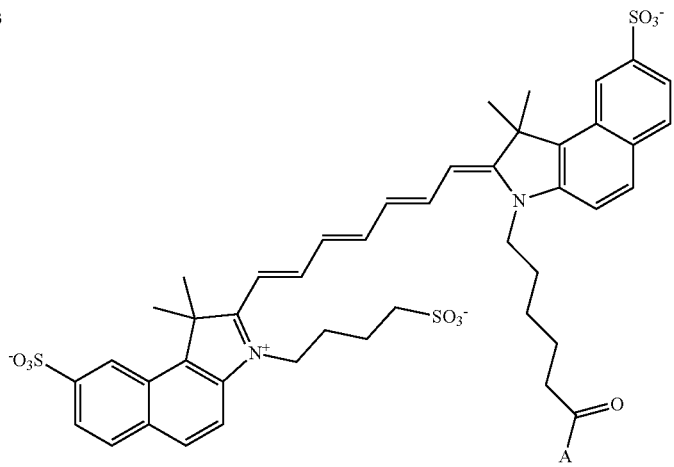
284
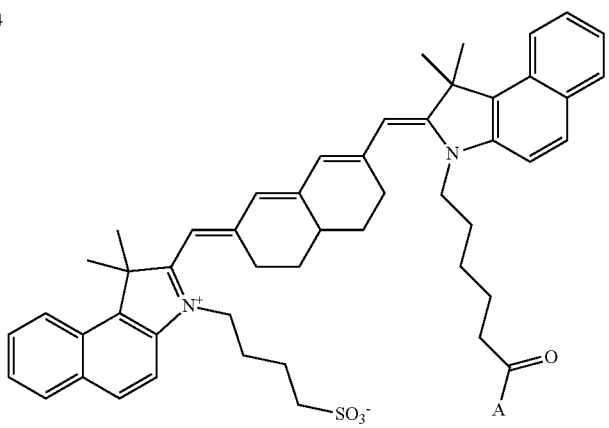
285
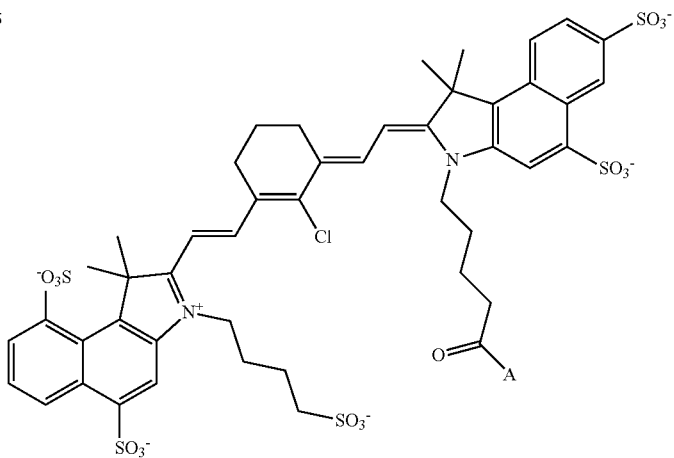

TABLE 6-continued
Exemplary compounds according to the present disclosure.
No. Structure
286
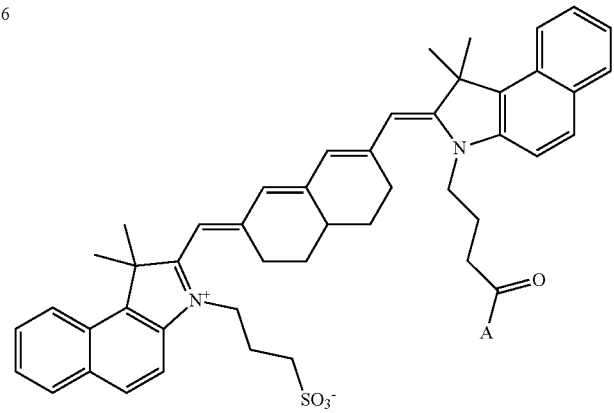
287
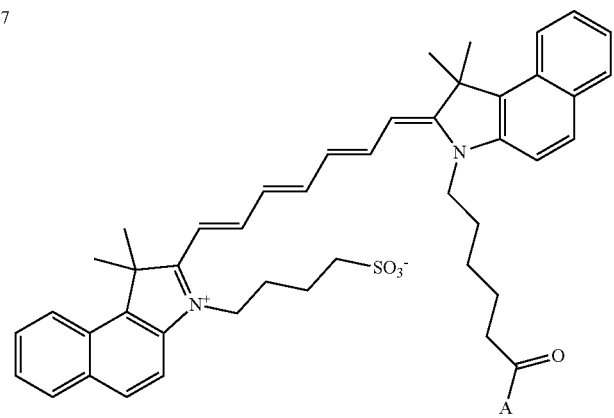
288
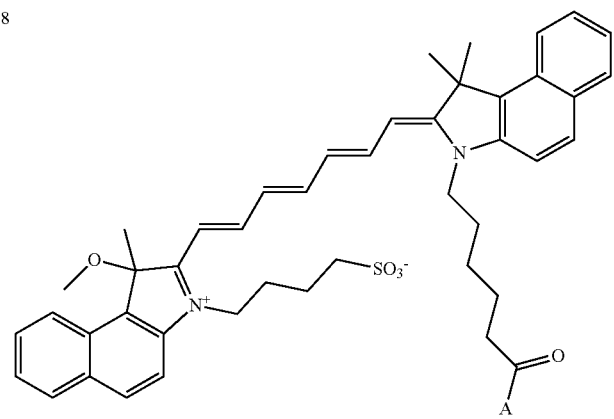

TABLE 6-continued
Exemplary compounds according to the present disclosure.
No. Structure
289
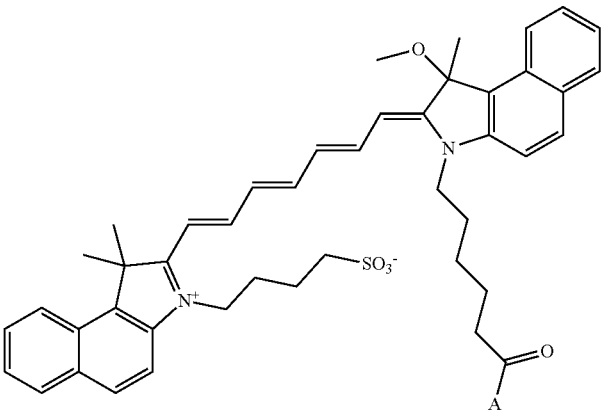
290
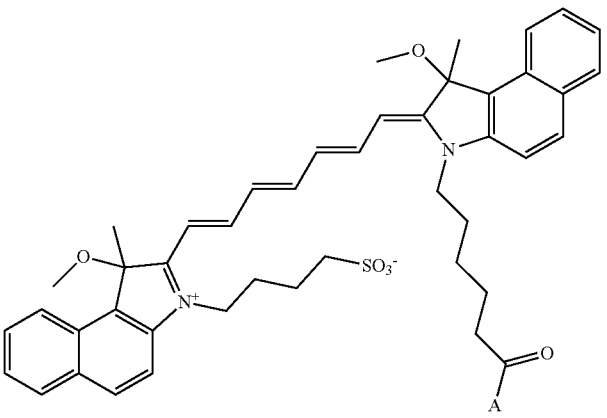
291
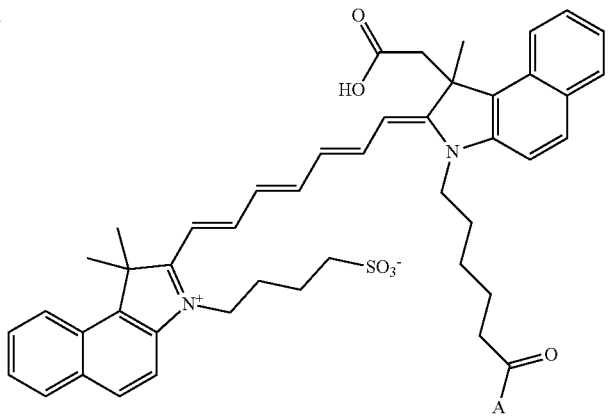

TABLE 6-continued
Exemplary compounds according to the present disclosure.
No. Structure
292
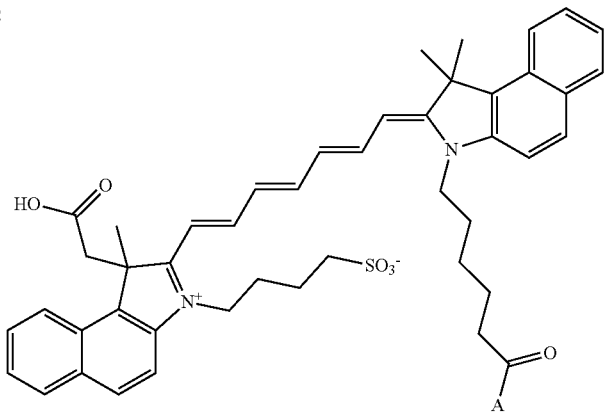
293
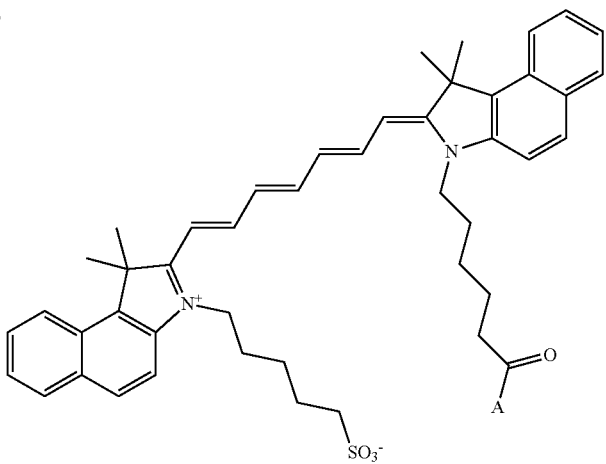
294
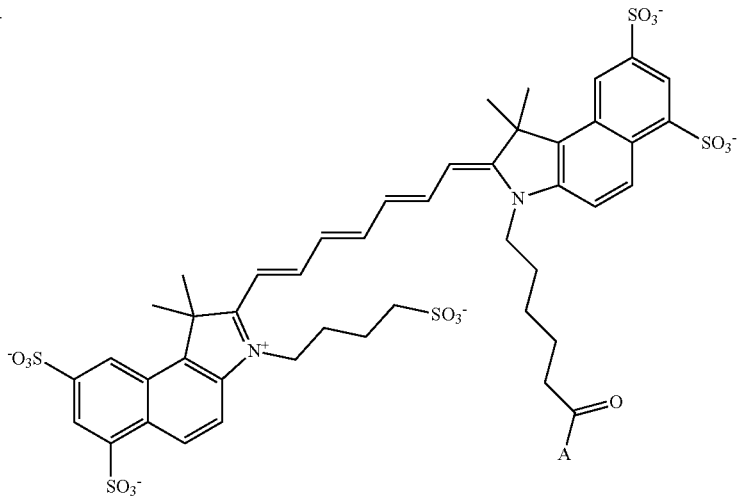

TABLE 6-continued
Exemplary compounds according to the present disclosure.
No. Structure
295 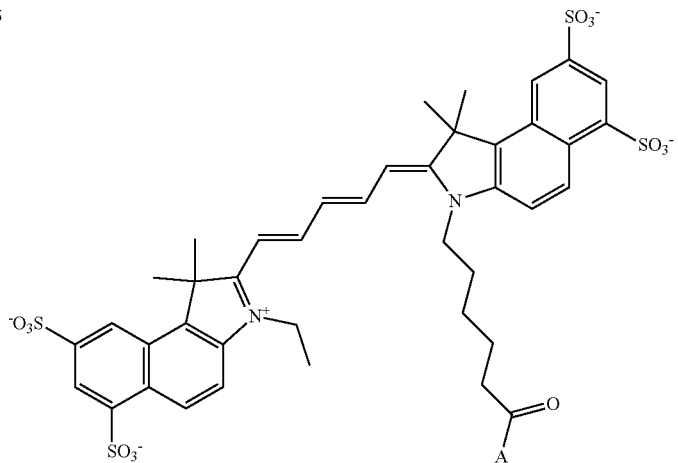
296 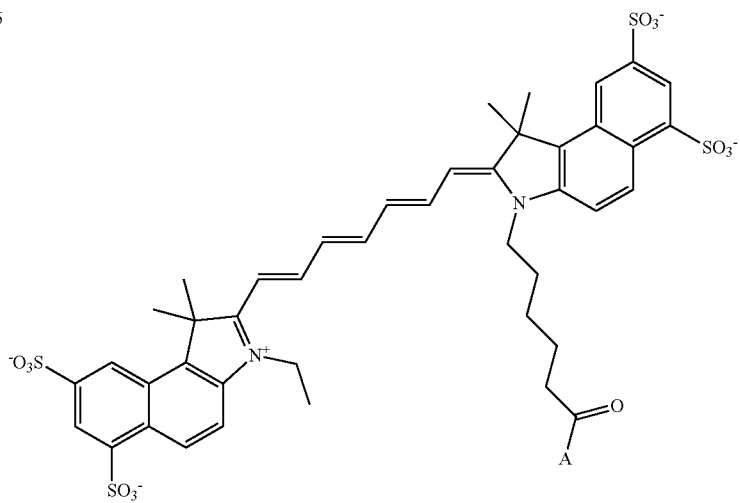
297 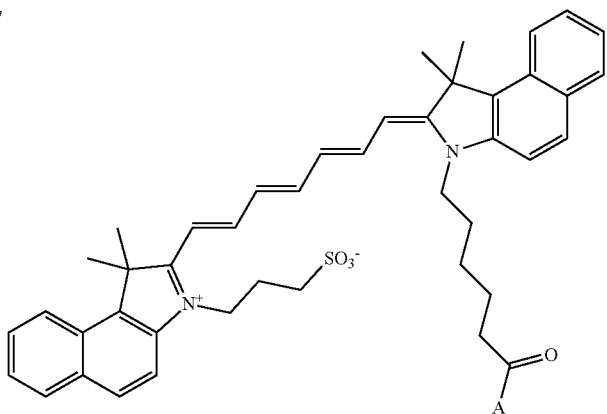

TABLE 6-continued
Exemplary compounds according to the present disclosure.
No. Structure
298
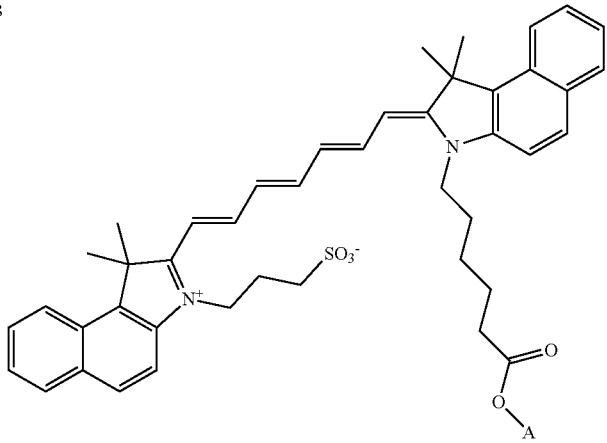
299
300
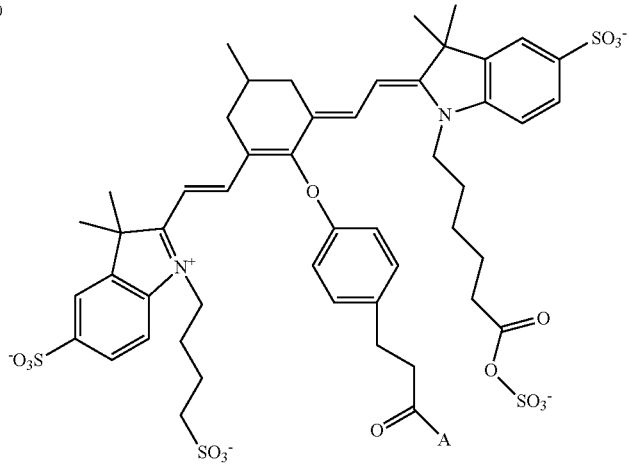
A = MCMPCFTTDHQMARACDDCCGGKGRGACYGPQCLCR (SEQ ID NO: 11) (attached at K-23)

TABLE 7
Exemplary compounds according to the present disclosure.
No. Structure
301
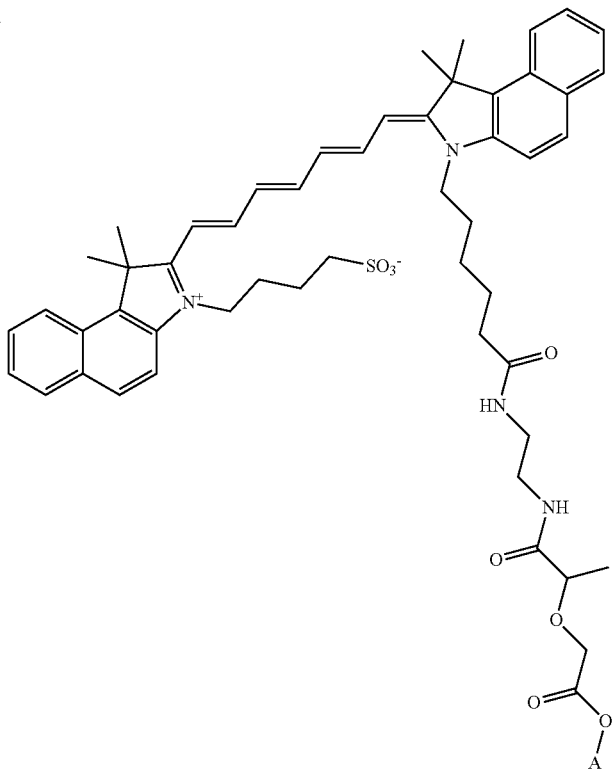
302
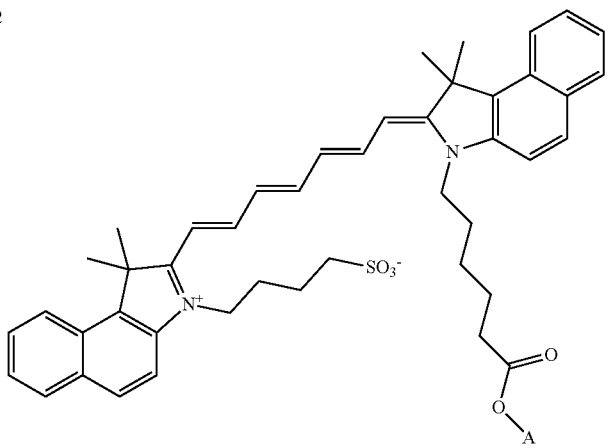

TABLE 7-continued
Exemplary compounds according to the present disclosure.
No. Structure
303 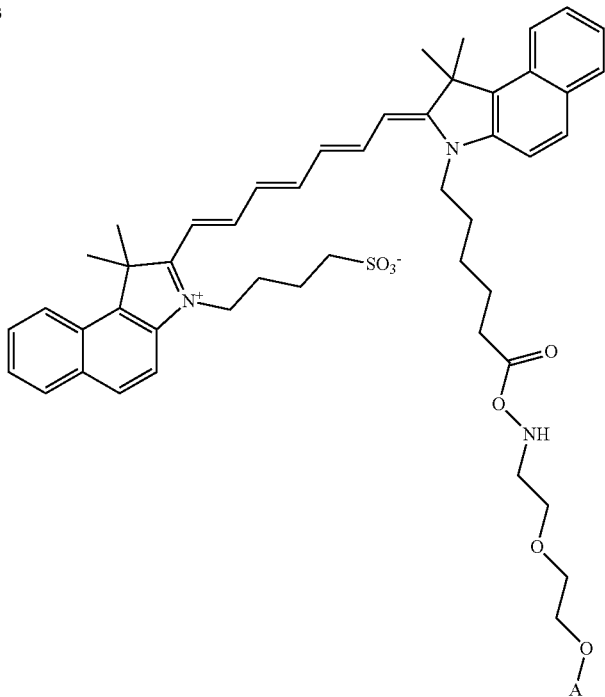
304 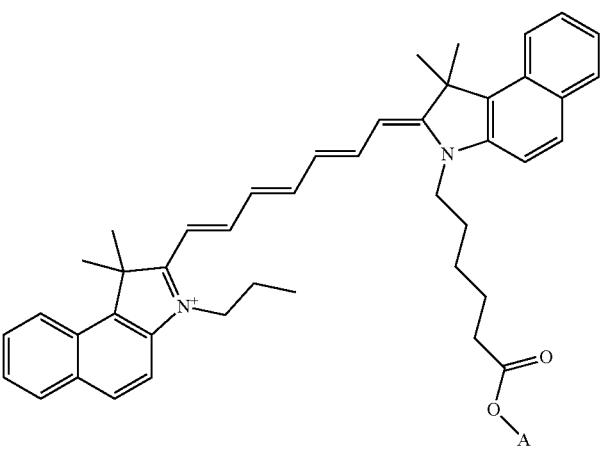
305 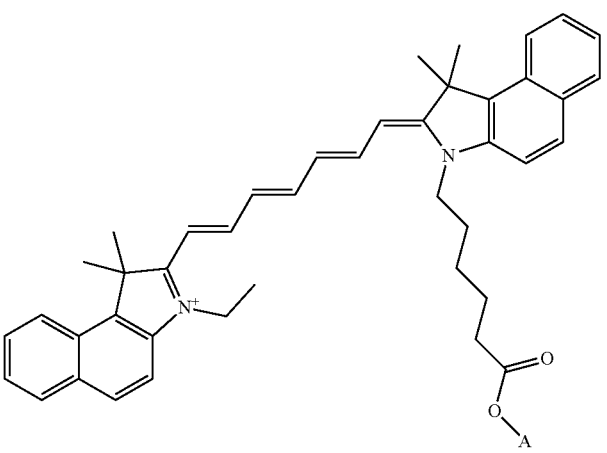

TABLE 7-continued
Exemplary compounds according to the present disclosure.
No. Structure
306
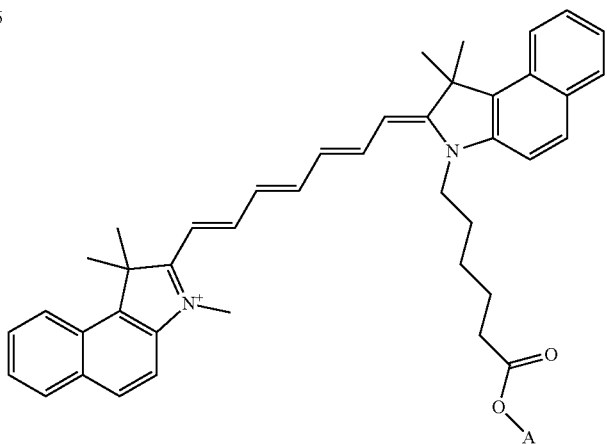
307
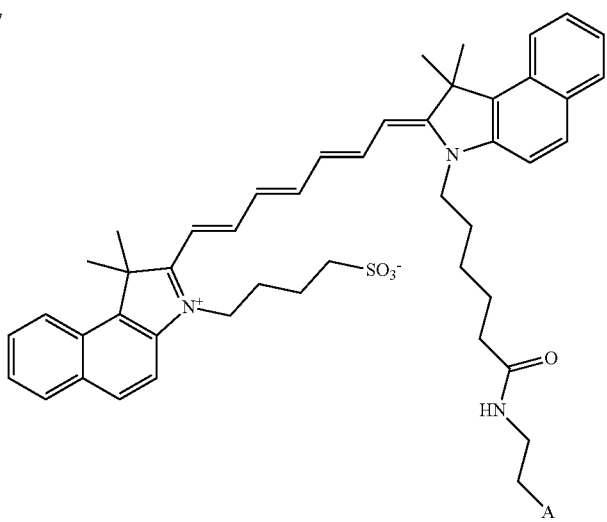
308
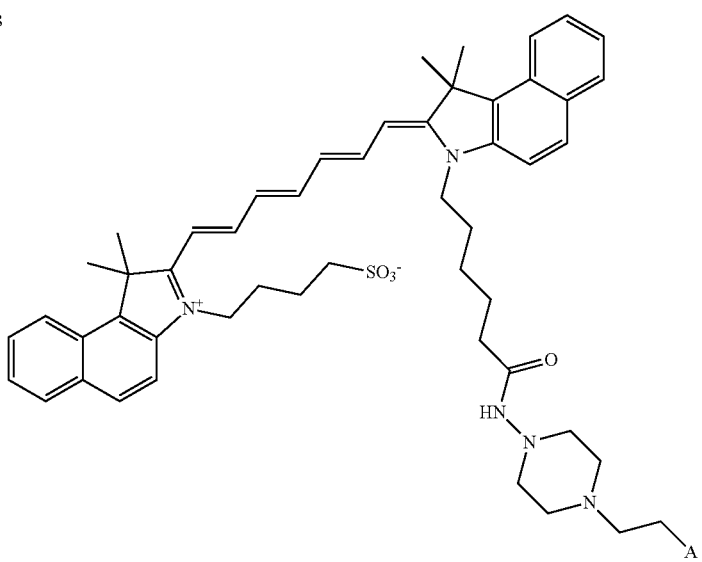

TABLE 7-continued
Exemplary compounds according to the present disclosure.
No. Structure
309
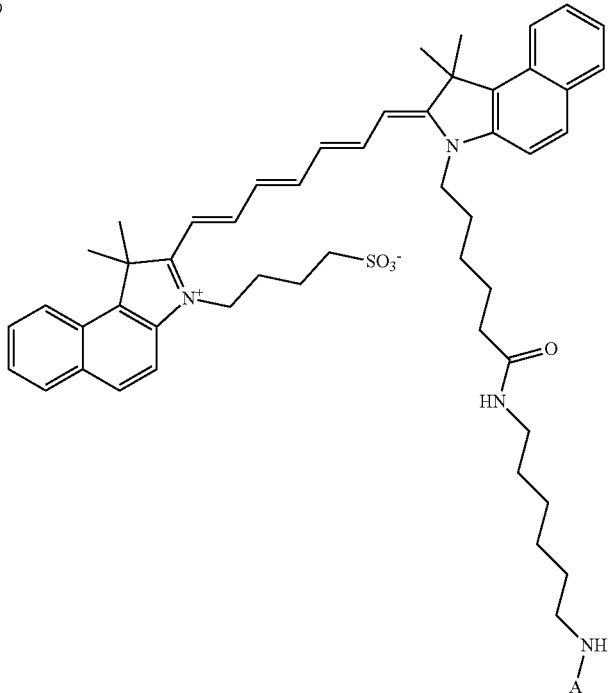
310
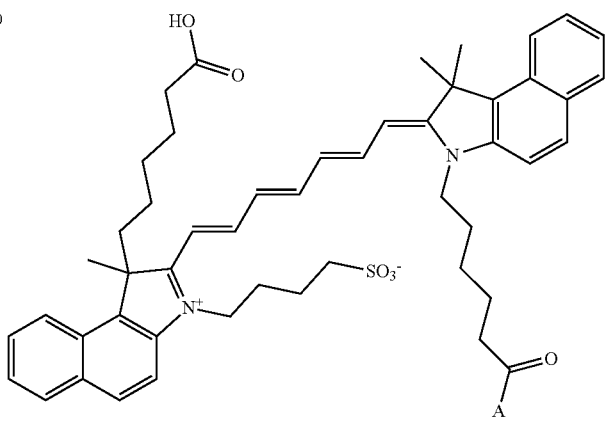
311
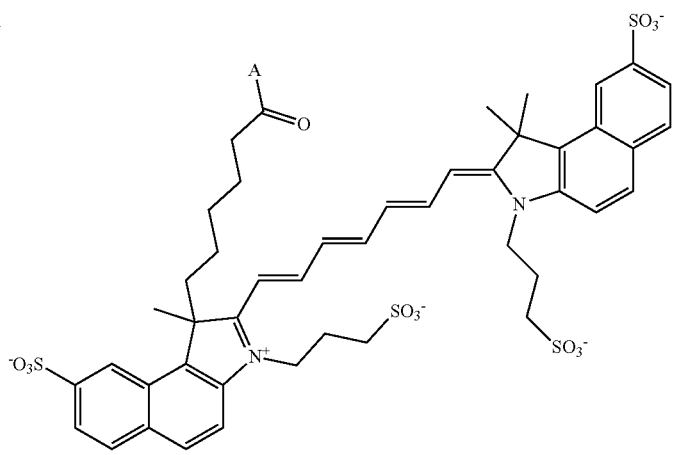

TABLE 7-continued
Exemplary compounds according to the present disclosure.
No. Structure
312 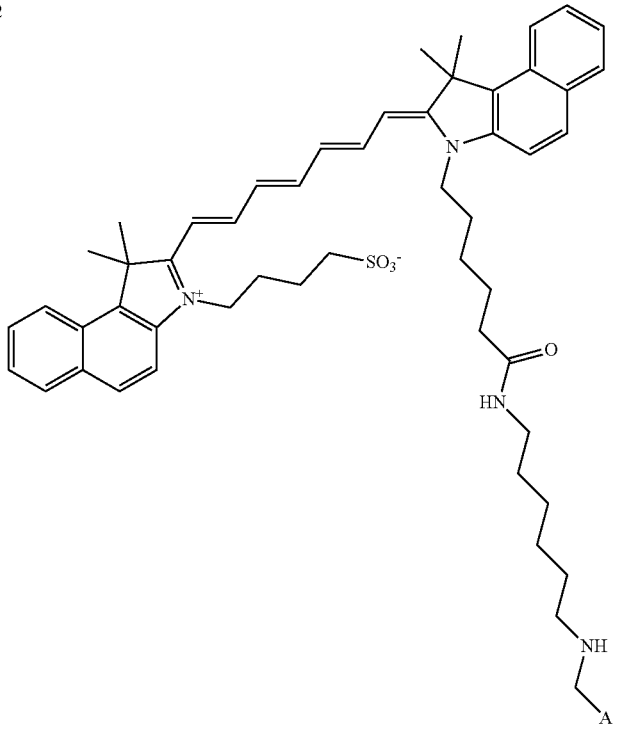
313 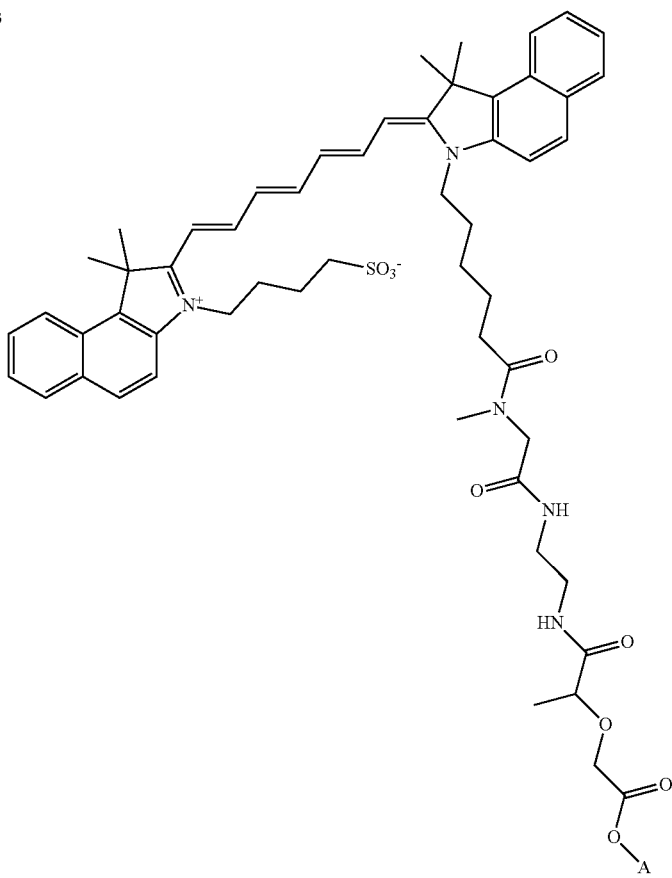

TABLE 7-continued
Exemplary compounds according to the present disclosure.
No. Structure
314
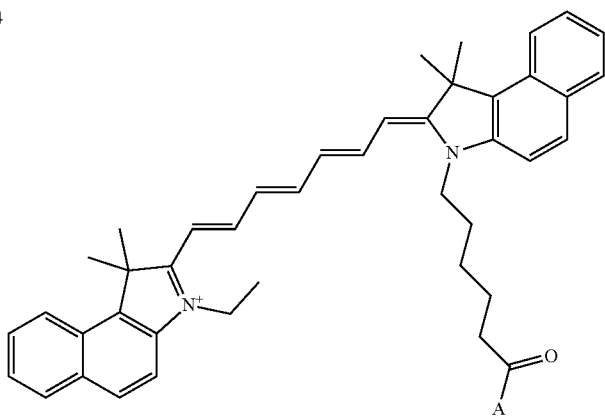
315
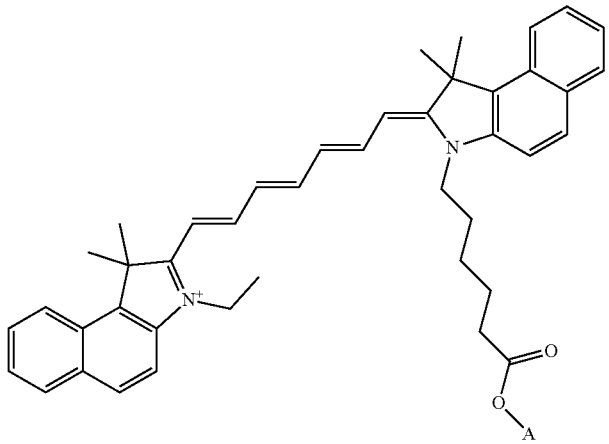
316
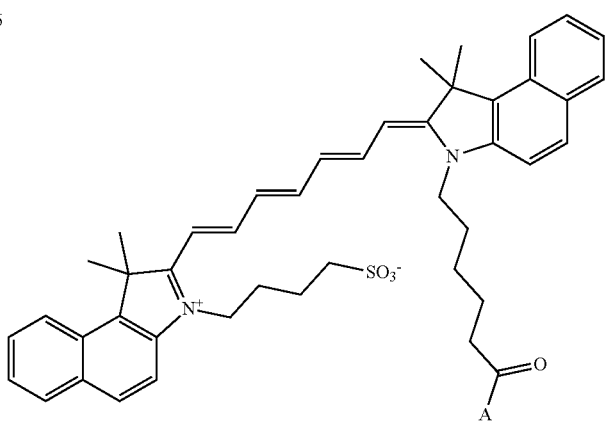

TABLE 7-continued
Exemplary compounds according to the present disclosure.
No. Structure
317
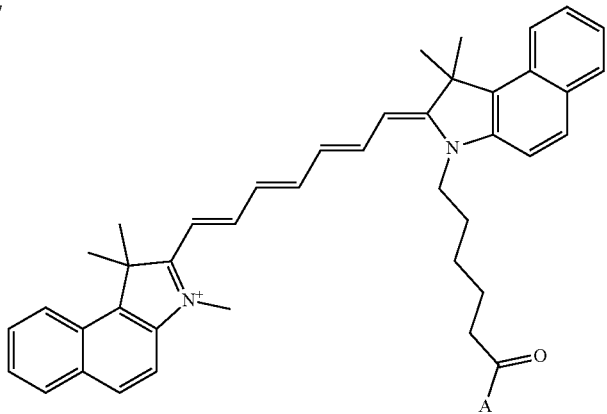
318
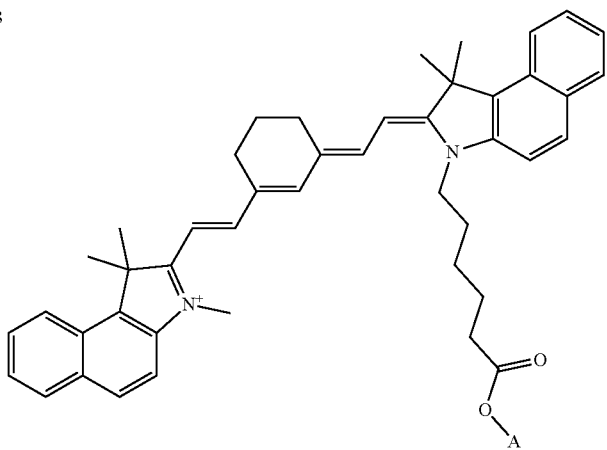
319
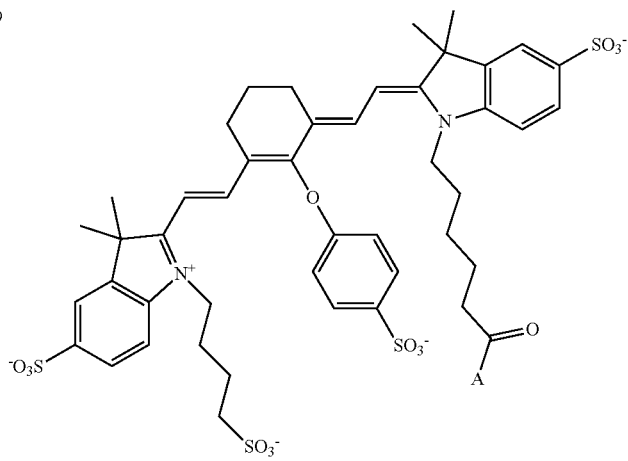

TABLE 7-continued
Exemplary compounds according to the present disclosure.
No. Structure
320 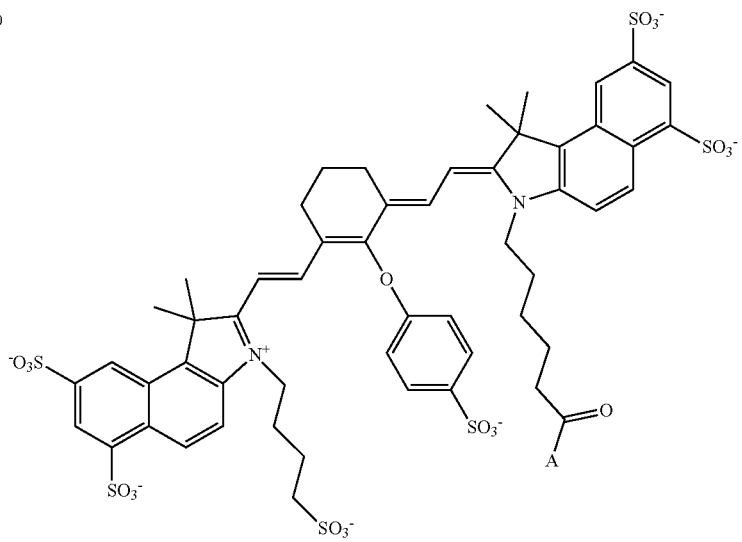
321 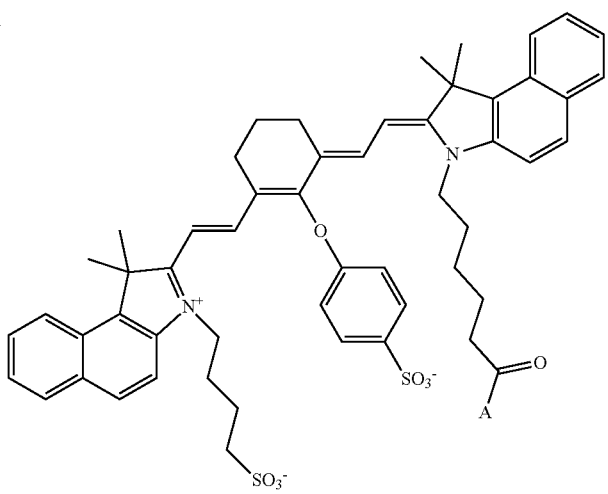
322 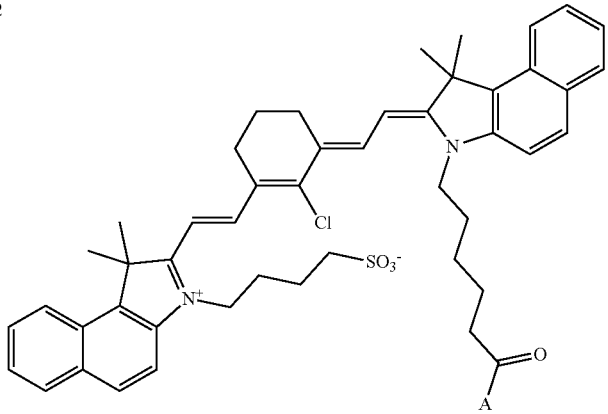

TABLE 7-continued
Exemplary compounds according to the present disclosure.
No. Structure
323
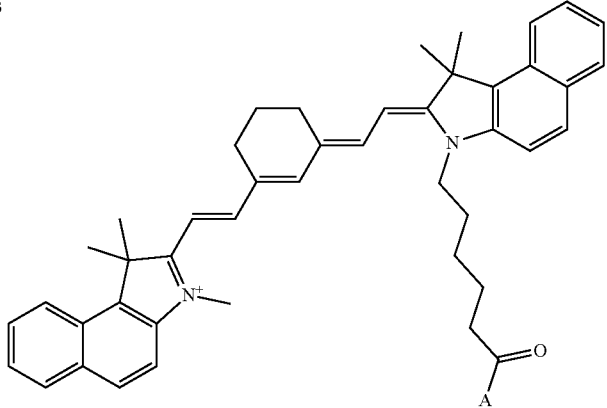
324
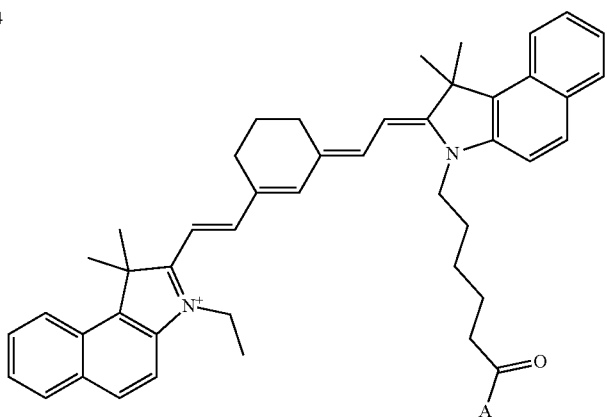
325
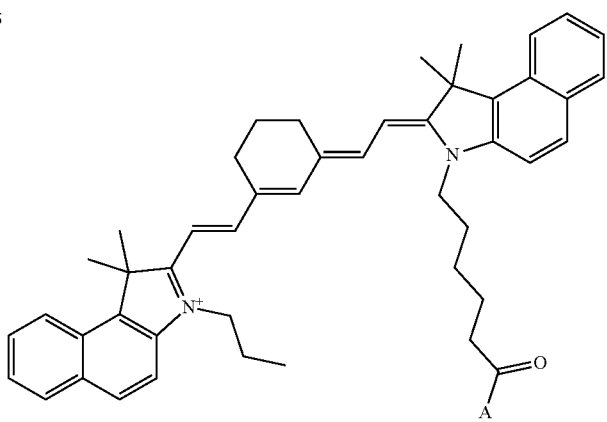

TABLE 7-continued
Exemplary compounds according to the present disclosure.
No. Structure
326
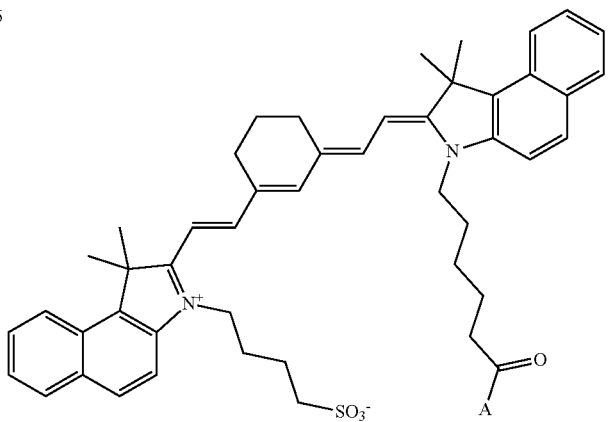
327
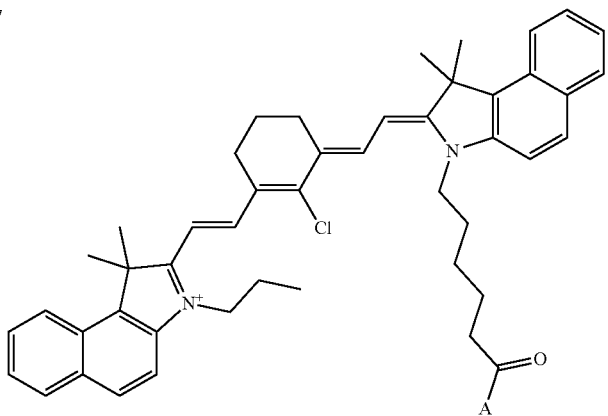
328
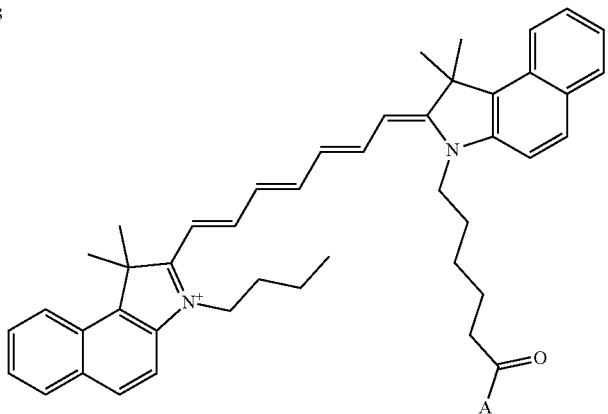

TABLE 7-continued
Exemplary compounds according to the present disclosure.
No. Structure
329
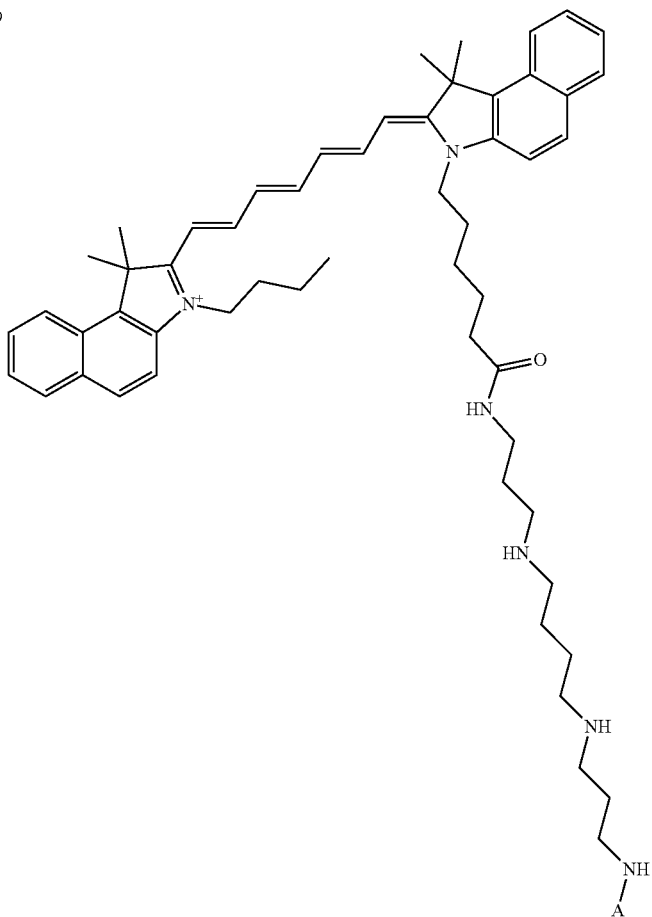
330
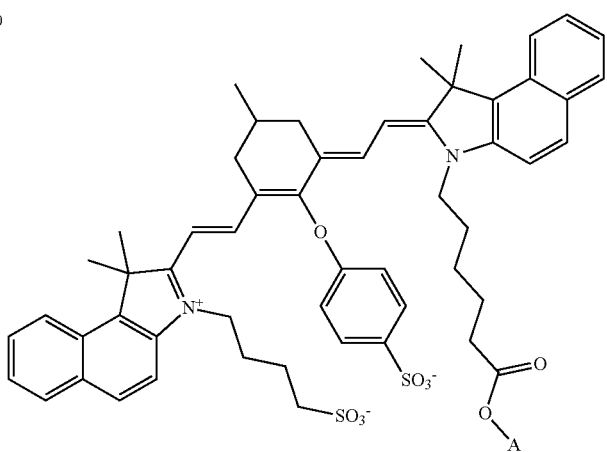

TABLE 7-continued
Exemplary compounds according to the present disclosure.
No. Structure
331 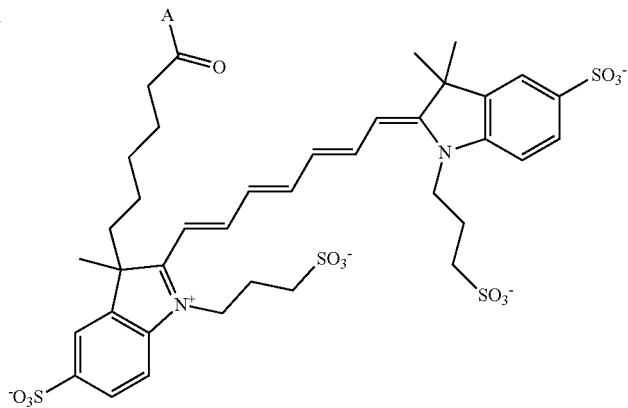
332 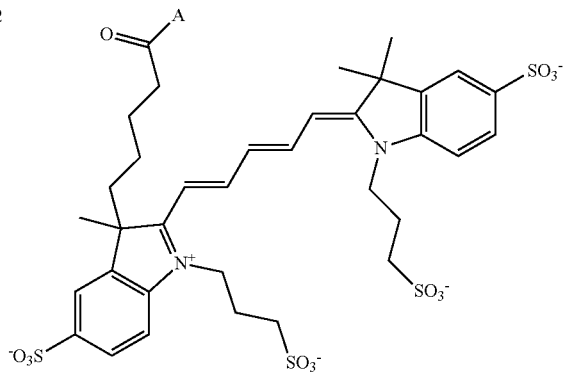
333 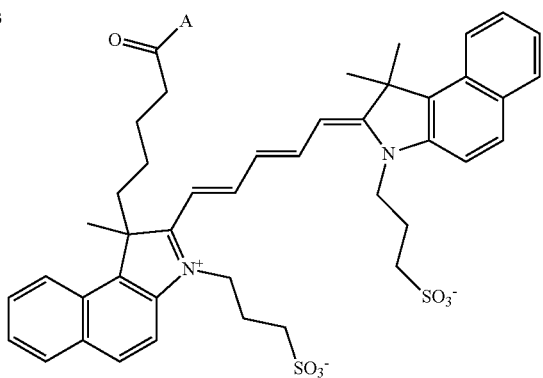

TABLE 7-continued
Exemplary compounds according to the present disclosure.
No. Structure
334
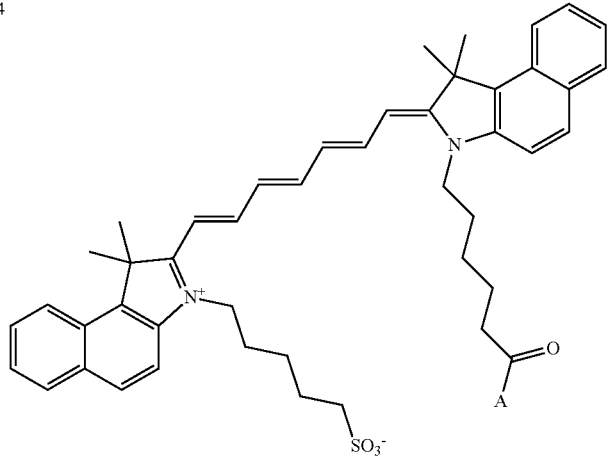
335
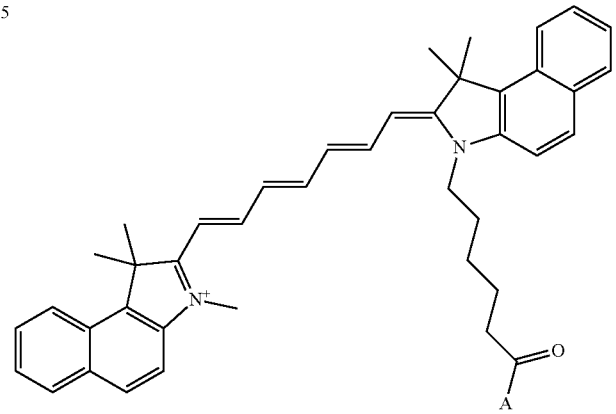
336
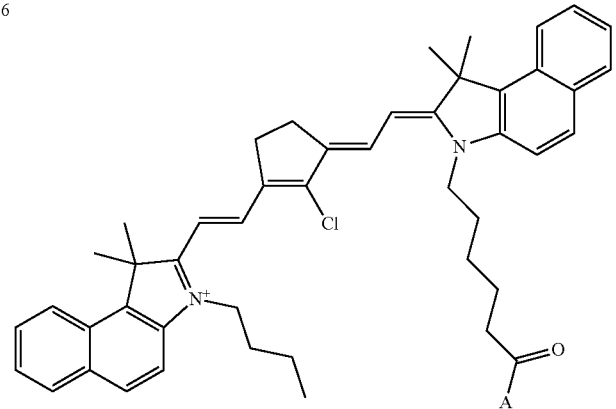

423
TABLE 7-continued
Exemplary compounds according to the present disclosure.
No. Structure
337
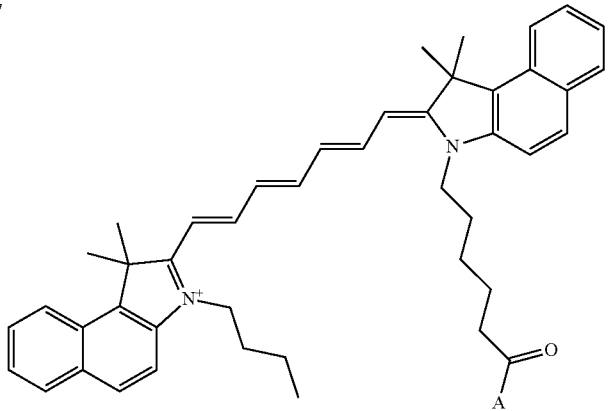
338
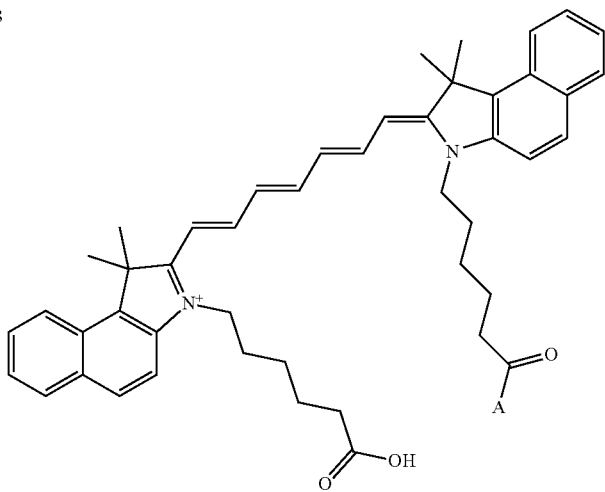
339
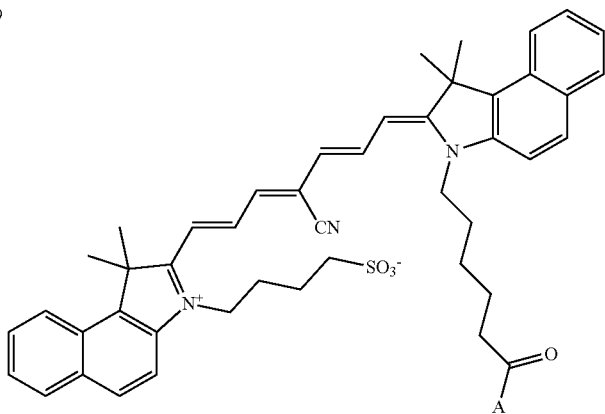

TABLE 7-continued
Exemplary compounds according to the present disclosure.
No. Structure
340
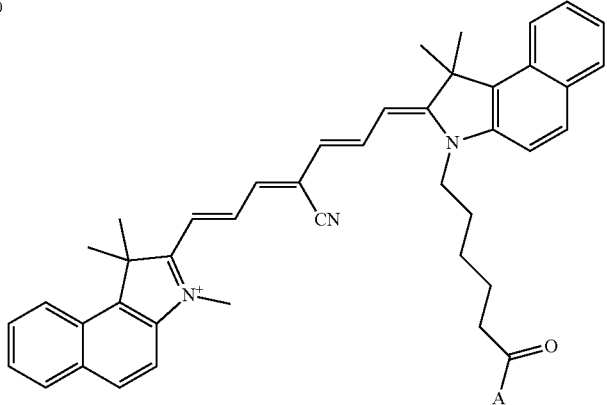
341
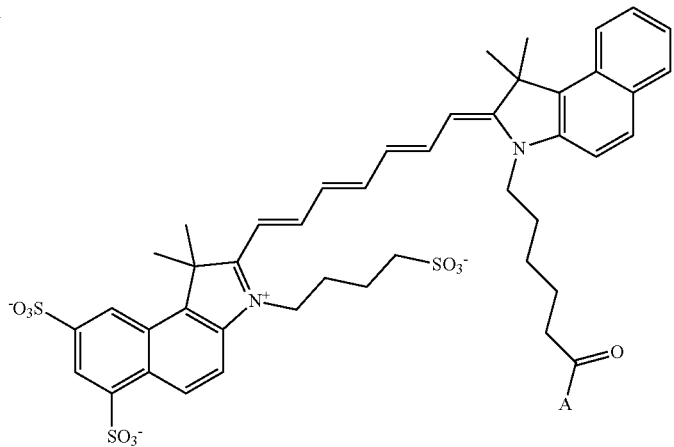
342
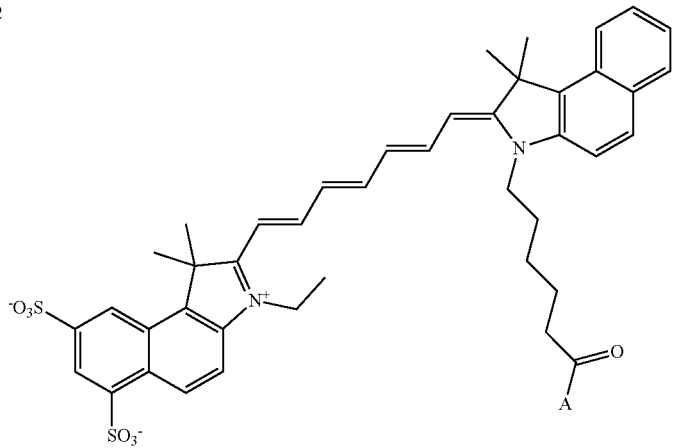

TABLE 7-continued
Exemplary compounds according to the present disclosure.
No. Structure
343
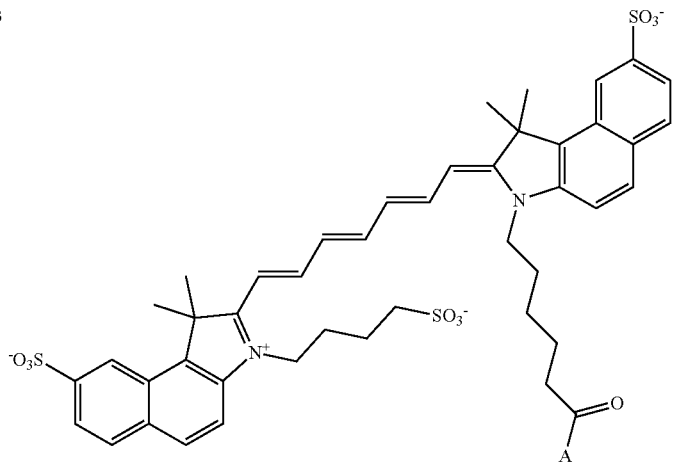
344
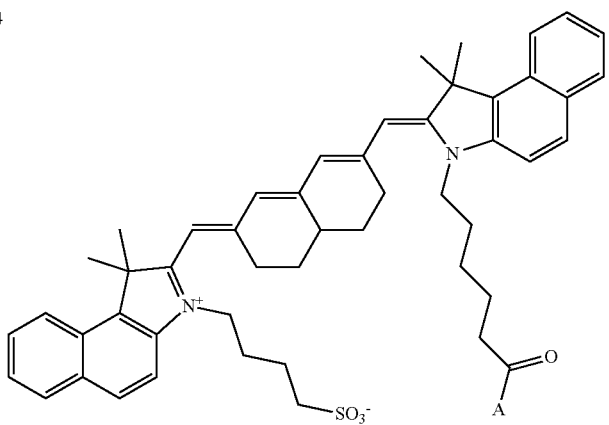
345
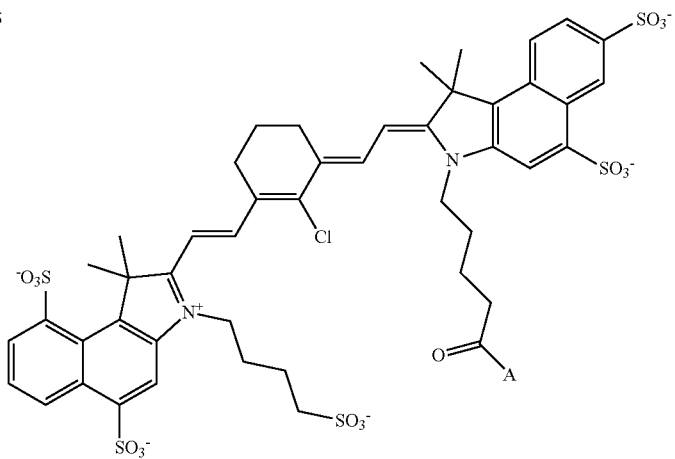

TABLE 7-continued
Exemplary compounds according to the present disclosure.
No. Structure
346
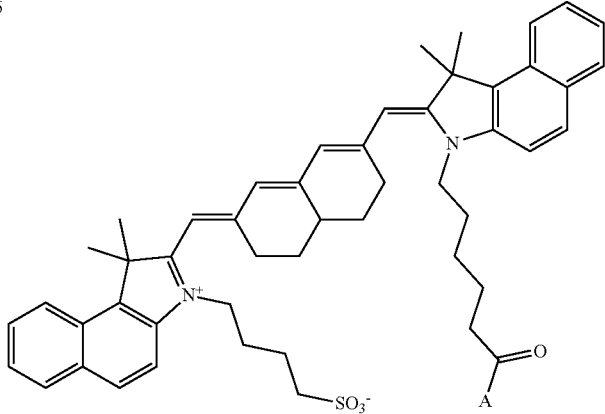
347
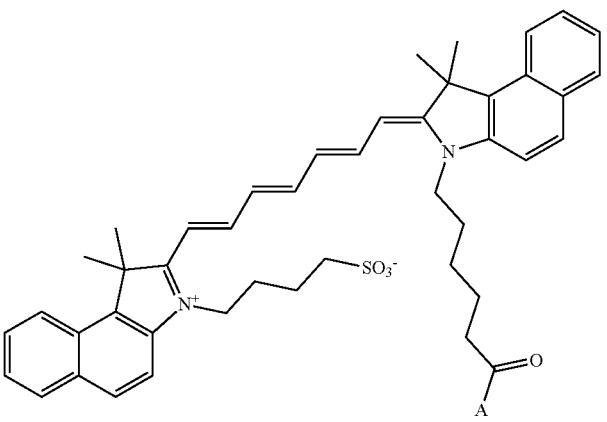
348
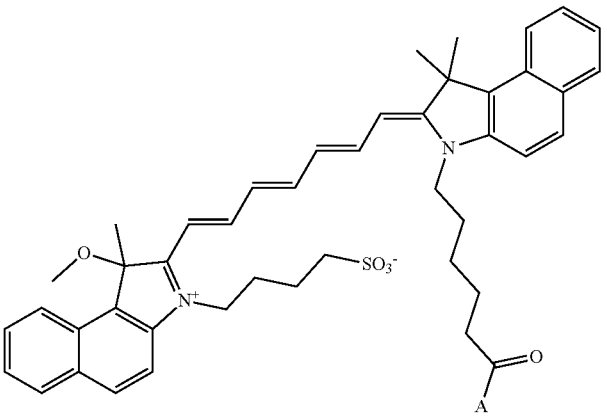

TABLE 7-continued
Exemplary compounds according to the present disclosure.
No. Structure
349
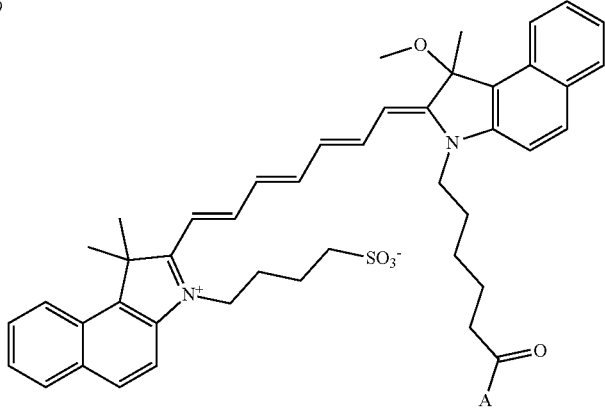
350
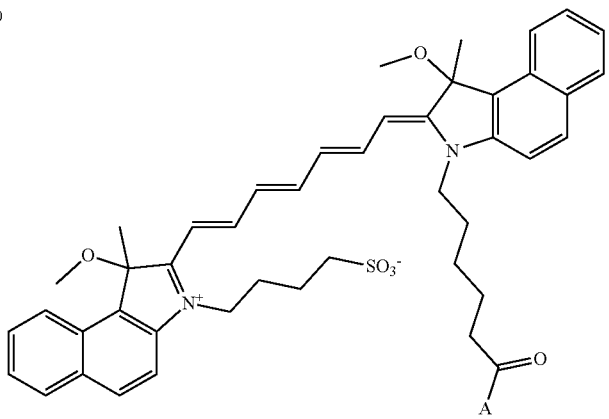
351
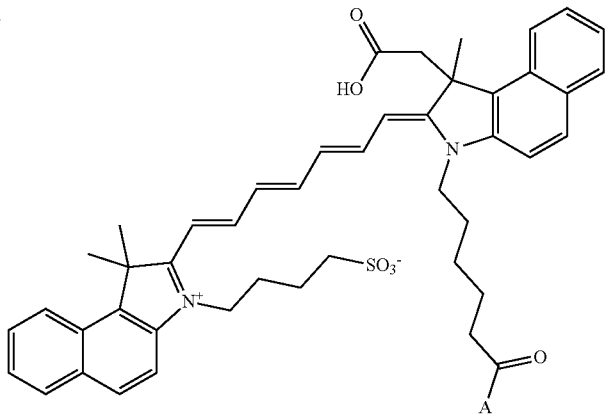

TABLE 7-continued
Exemplary compounds according to the present disclosure.
No. Structure
352
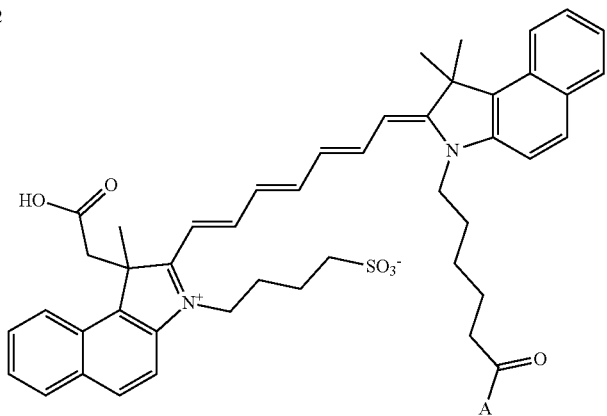
353
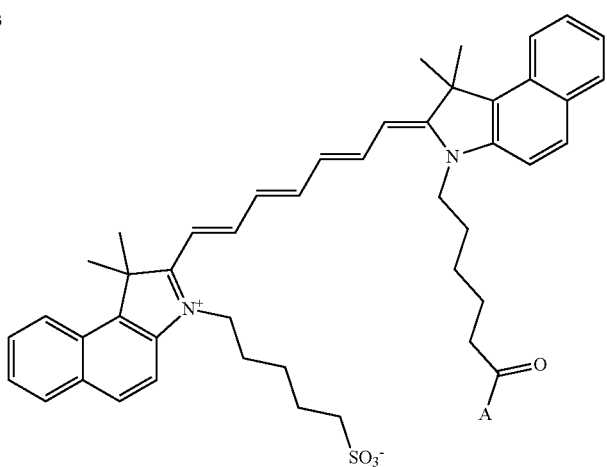
354
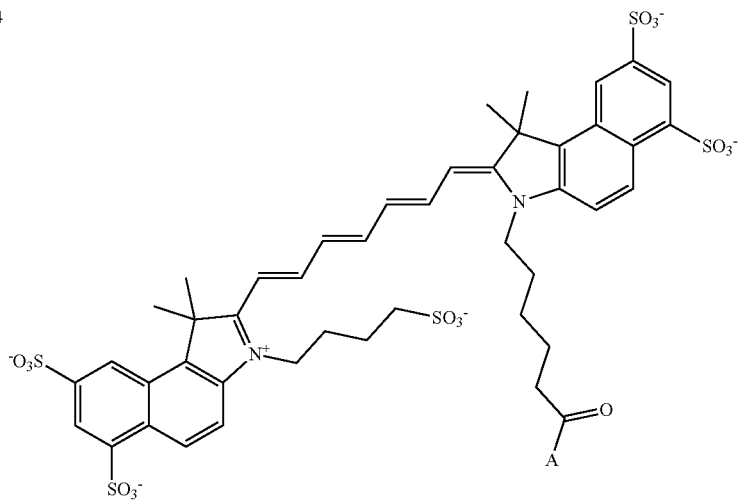

TABLE 7-continued
Exemplary compounds according to the present disclosure.
No. Structure
355
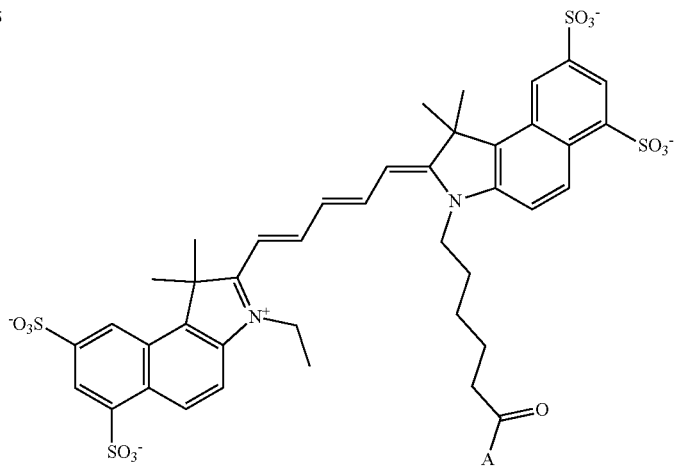
356
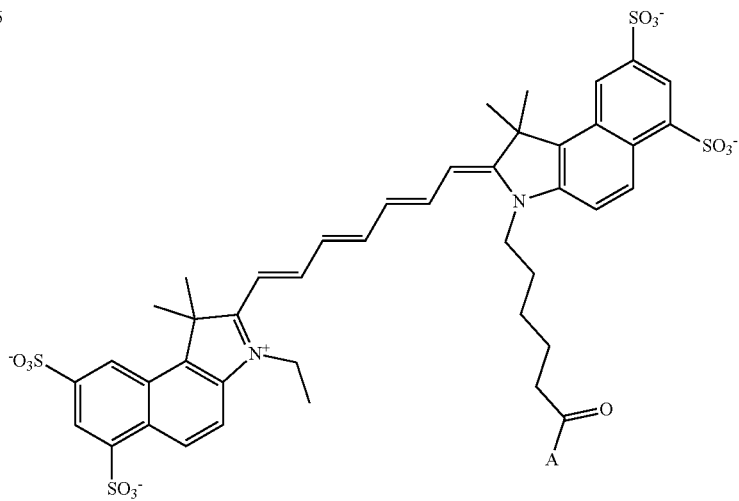
357
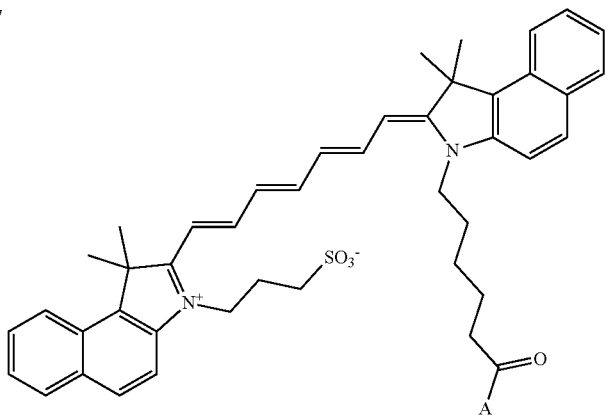

TABLE 7-continued
Exemplary compounds according to the present disclosure.
No. Structure
358
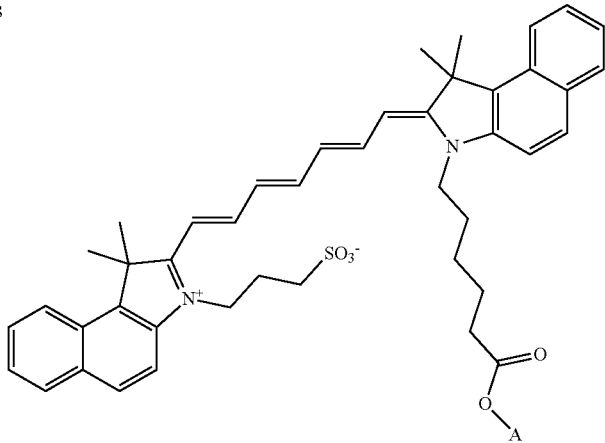
359
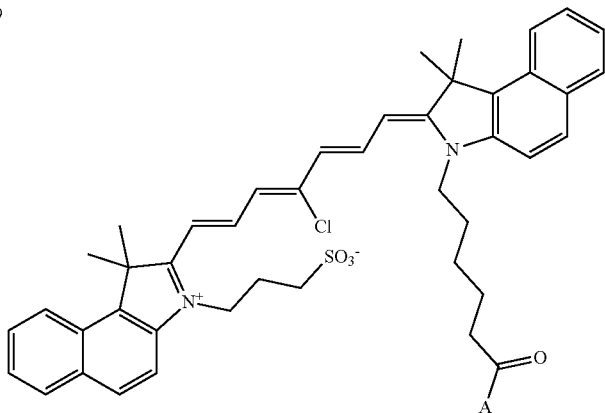
360
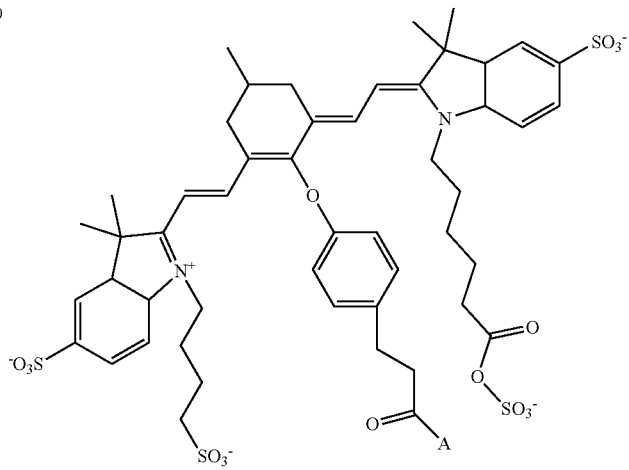
A = MCMPCFTTDHQMARRCDDCCGGKGRGACYGPQCLCR (SEQ ID NO: 12) (attached at K-23)

TABLE 8
Exemplary compounds according to the present disclosure.
No. Structure
361
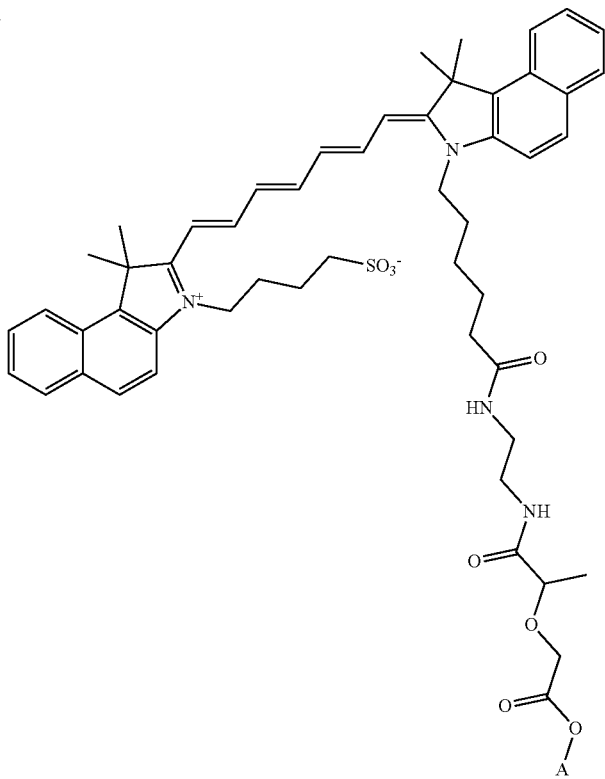
362
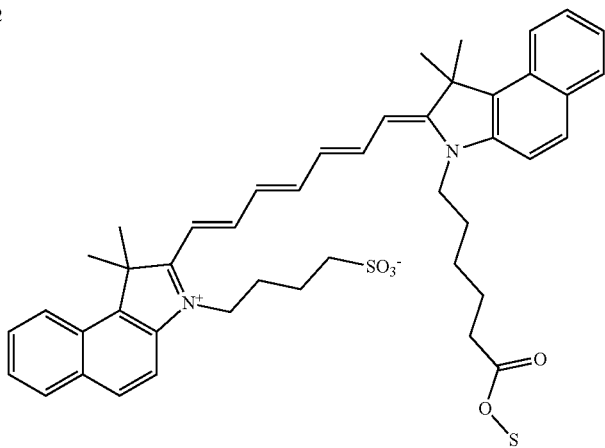

TABLE 8-continued
Exemplary compounds according to the present disclosure.
No. Structure
363 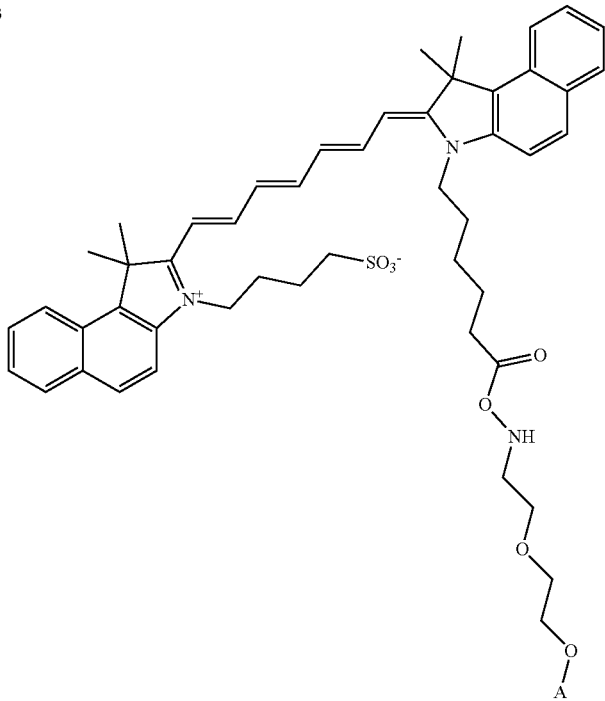
364 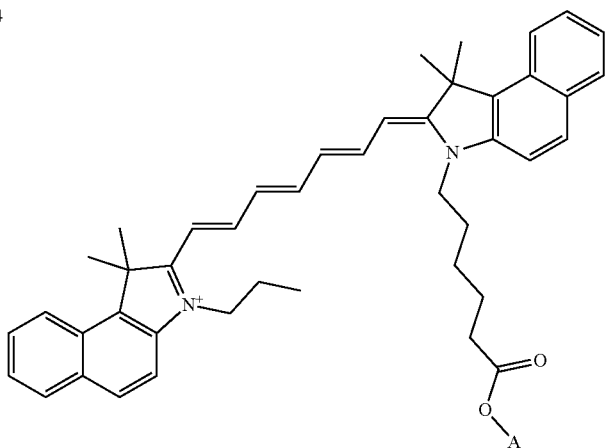

TABLE 8-continued
Exemplary compounds according to the present disclosure.
No. Structure
365 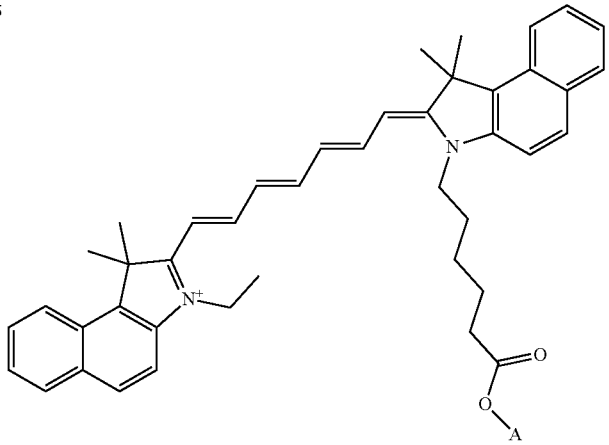
366 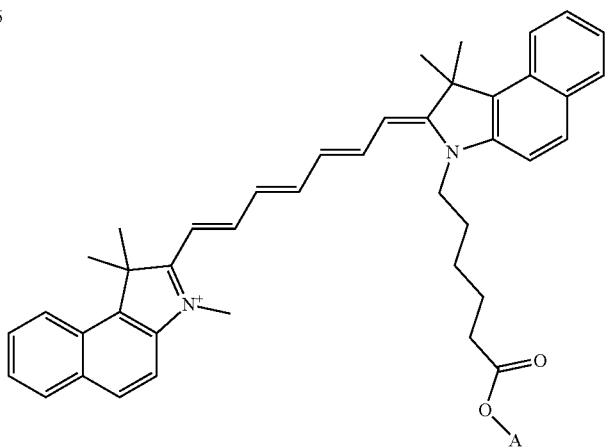
367 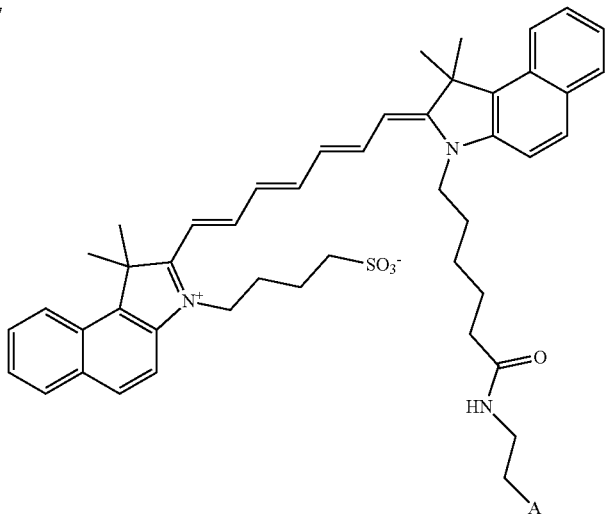

TABLE 8-continued
Exemplary compounds according to the present disclosure.
No. Structure
368
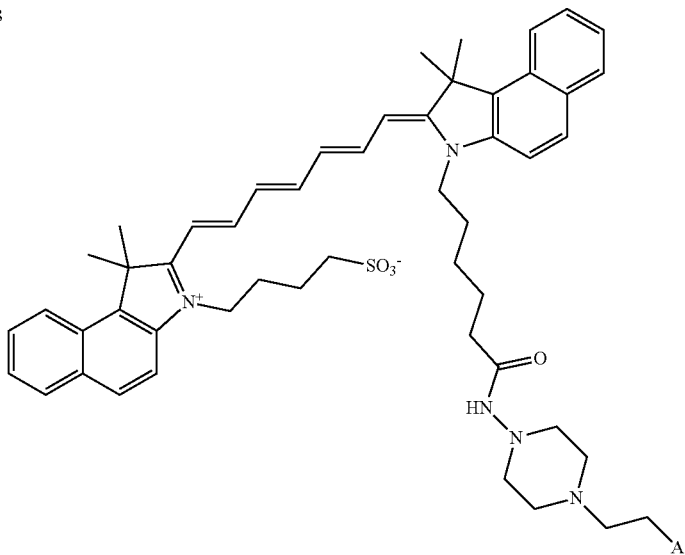
369
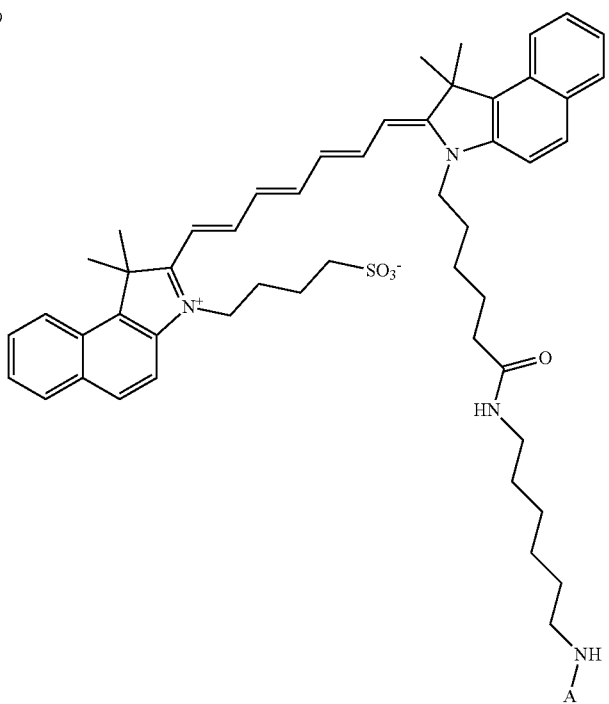

TABLE 8-continued
Exemplary compounds according to the present disclosure.
No. Structure
370 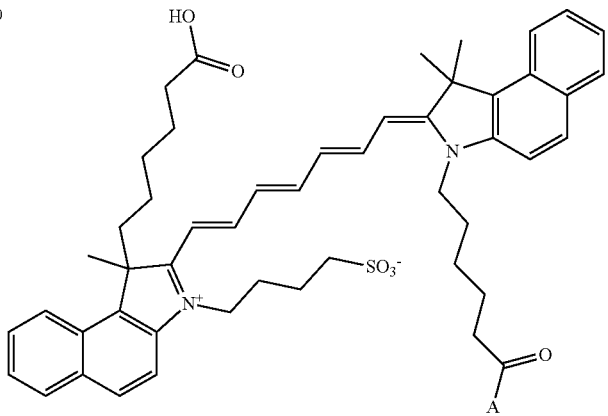
371 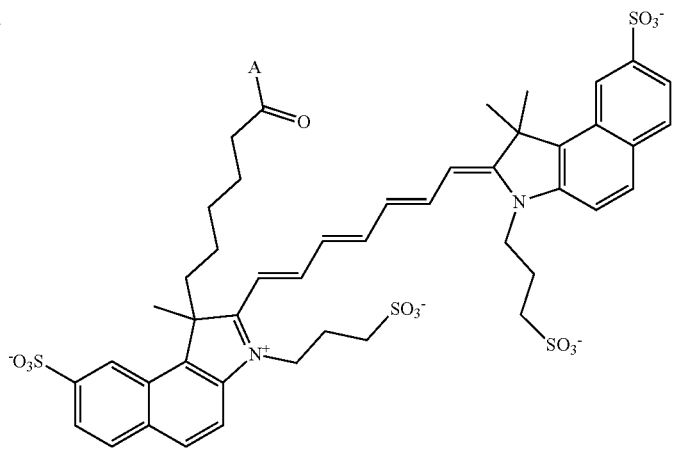

449
TABLE 8-continued
Exemplary compounds according to the present disclosure.
No. Structure
372
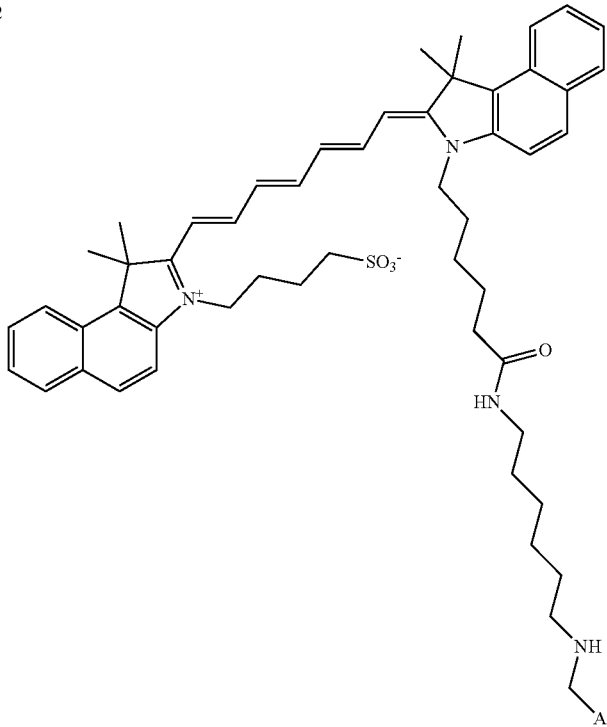
373
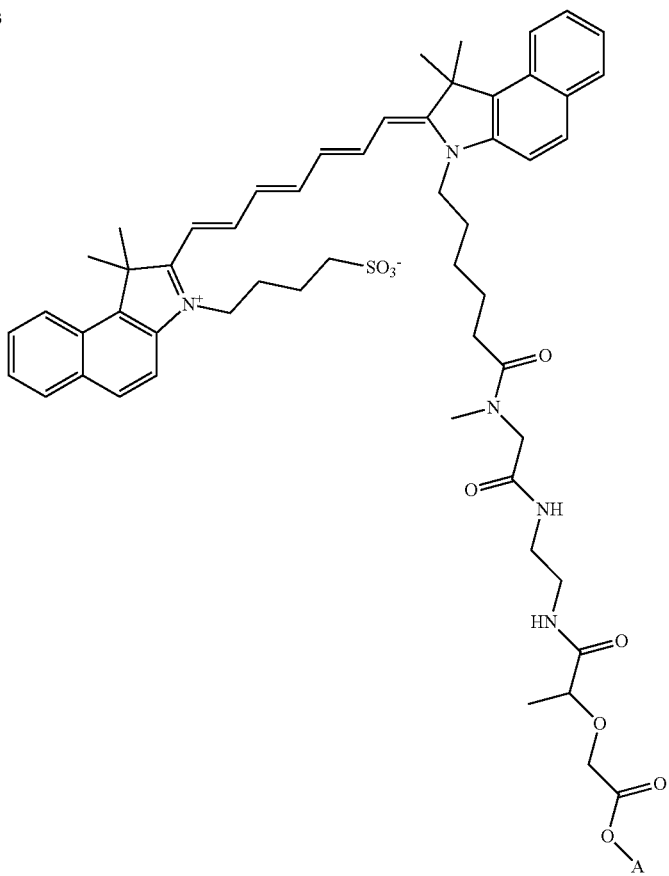

TABLE 8-continued
Exemplary compounds according to the present disclosure.
No. Structure
374
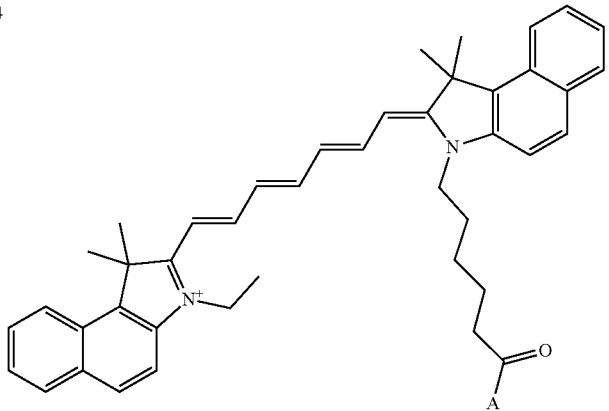
375
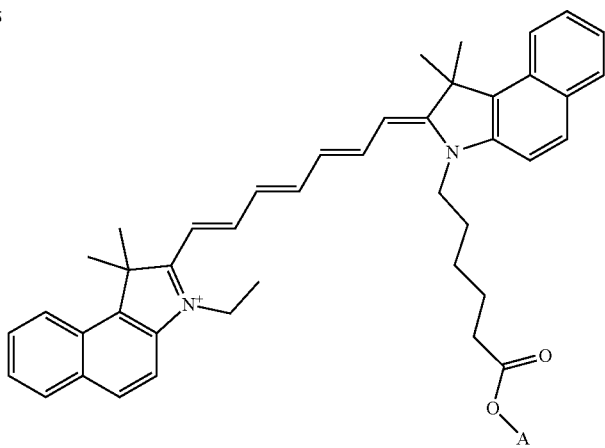
376
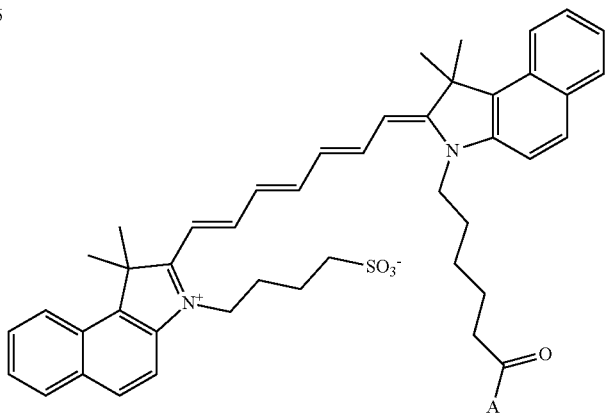

TABLE 8-continued
Exemplary compounds according to the present disclosure.
No. Structure
377
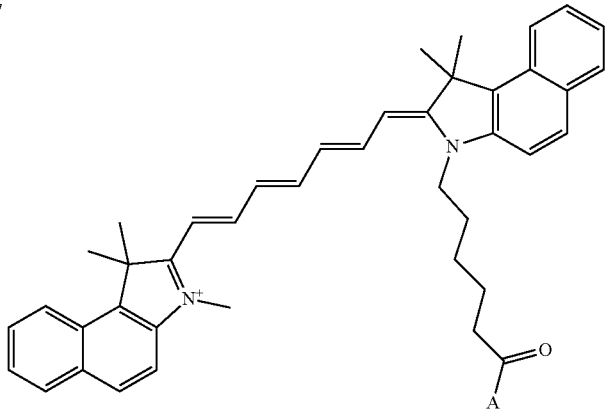
378
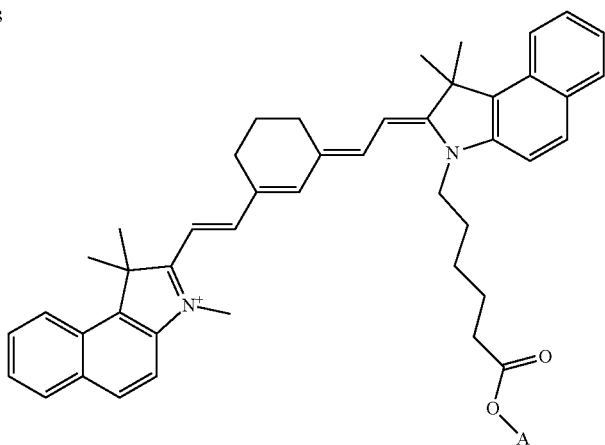
379
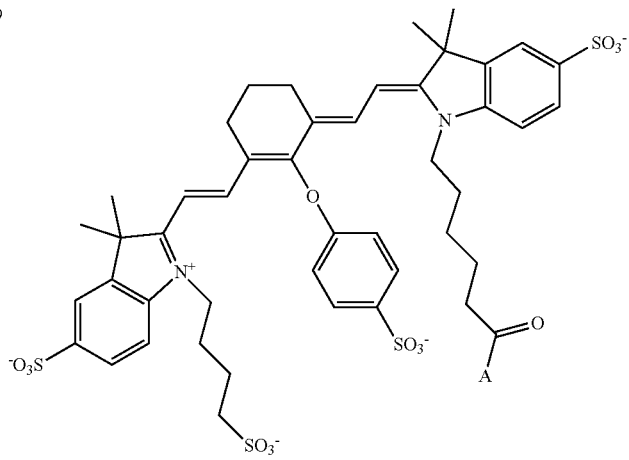

TABLE 8-continued
Exemplary compounds according to the present disclosure.
No. Structure
380 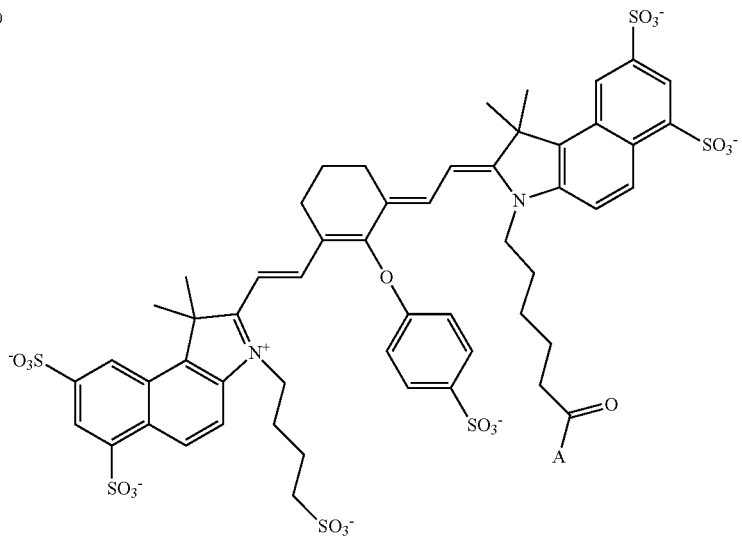
381 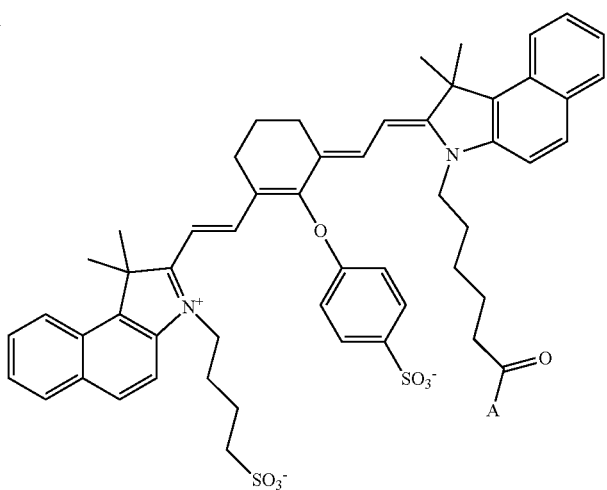
382 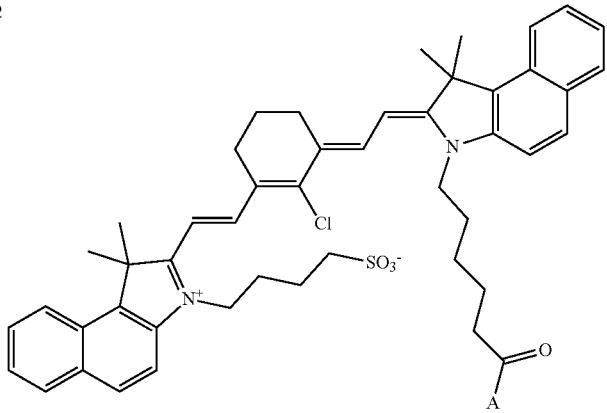

TABLE 8-continued
Exemplary compounds according to the present disclosure.
No. Structure
383
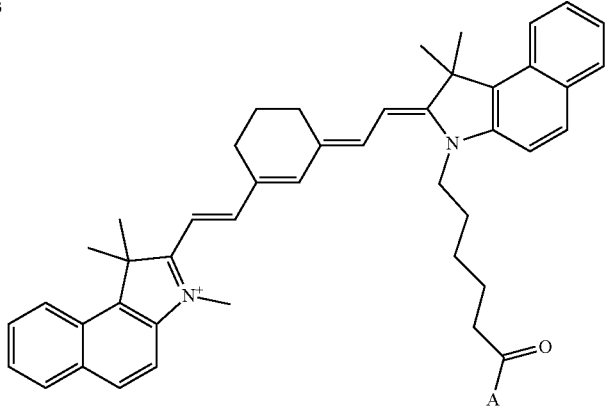
384
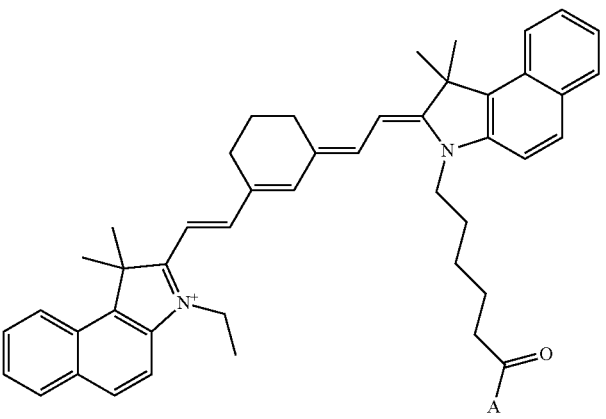
385
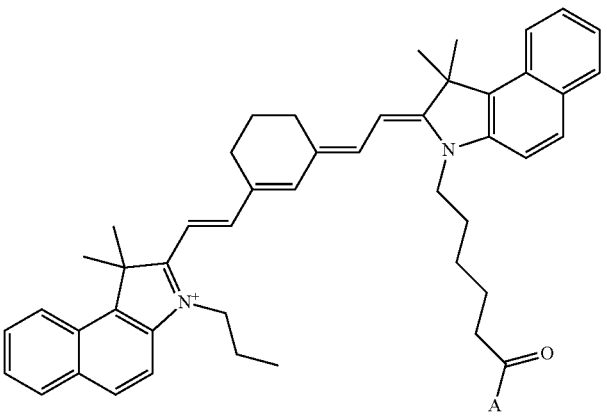

459 460
TABLE 8-continued
Exemplary compounds according to the present disclosure.
No. Structure
386
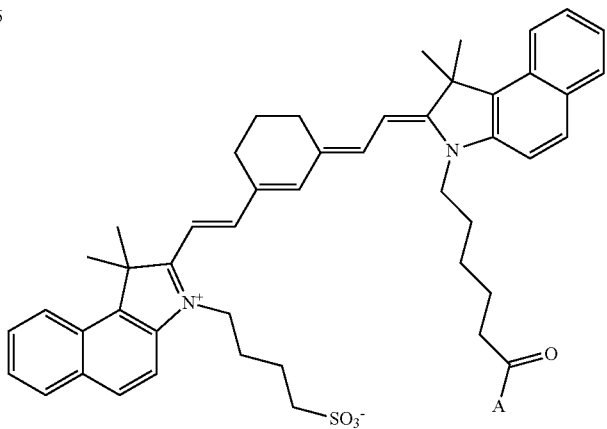
387
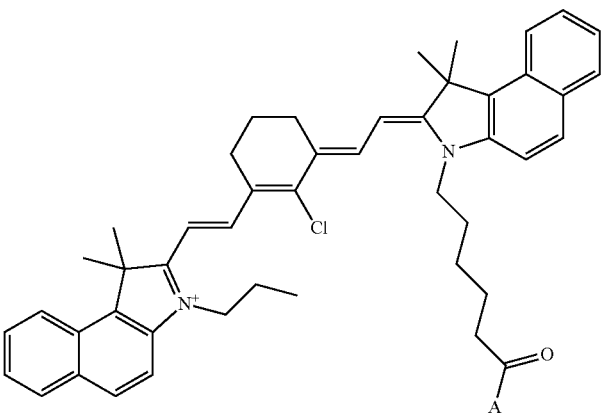
388
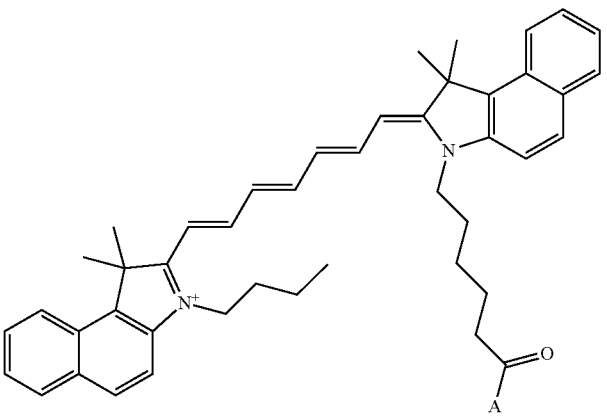

TABLE 8-continued
Exemplary compounds according to the present disclosure.
No. Structure
389
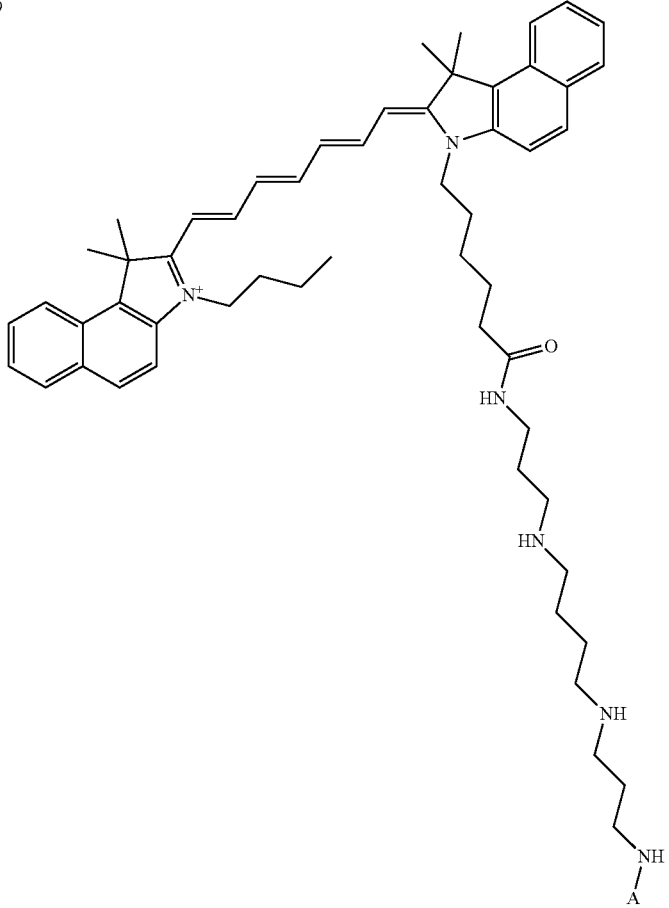
390
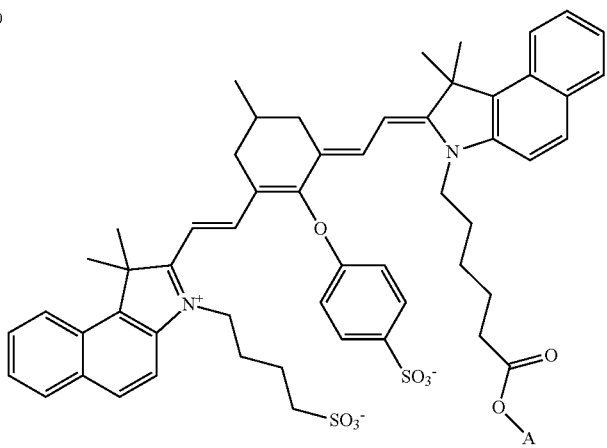

TABLE 8-continued
Exemplary compounds according to the present disclosure.
No. Structure
391 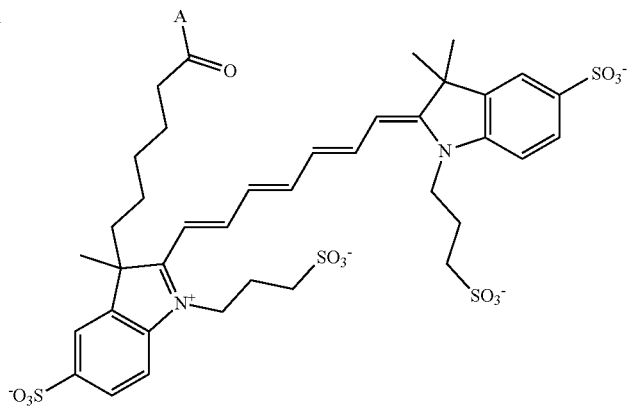
392 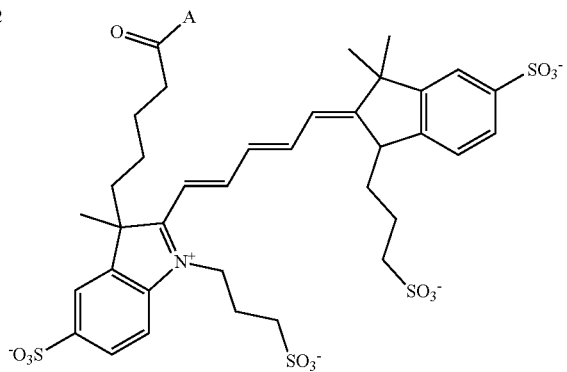
393 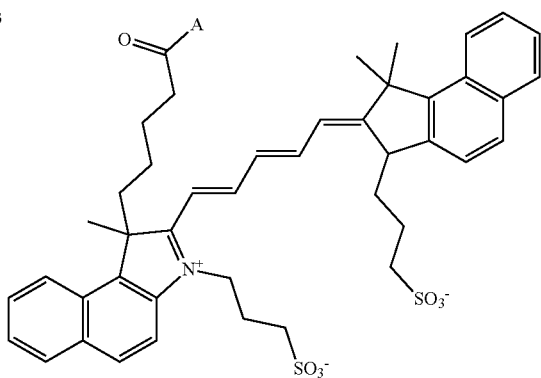

TABLE 8-continued
Exemplary compounds according to the present disclosure.
No. Structure
394
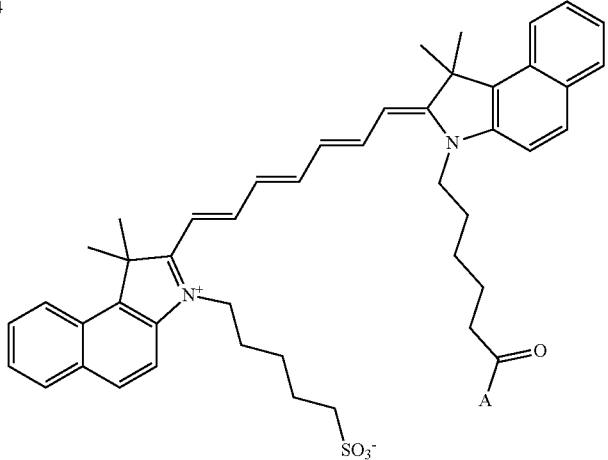
395
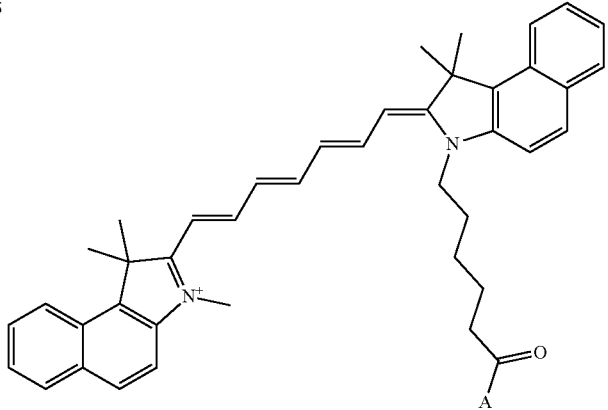
396
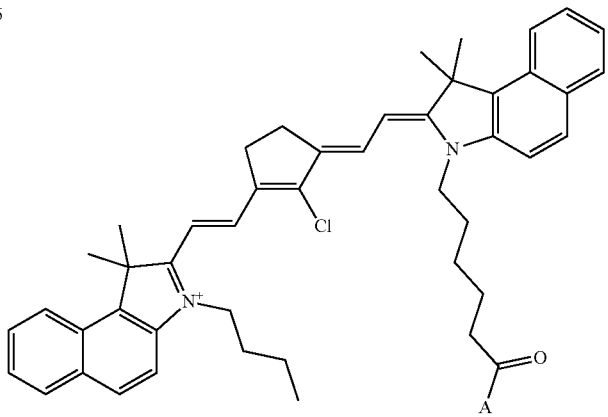

TABLE 8-continued
Exemplary compounds according to the present disclosure.
No. Structure
397
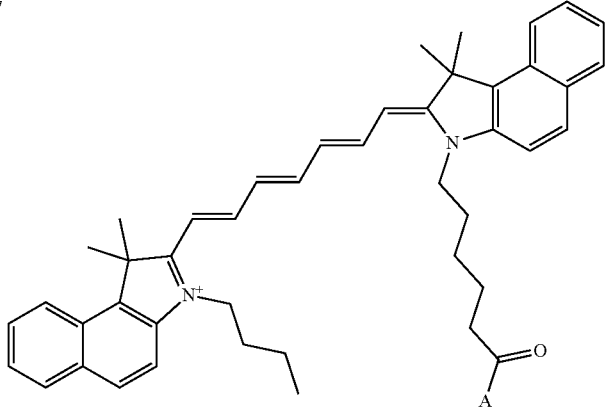
398
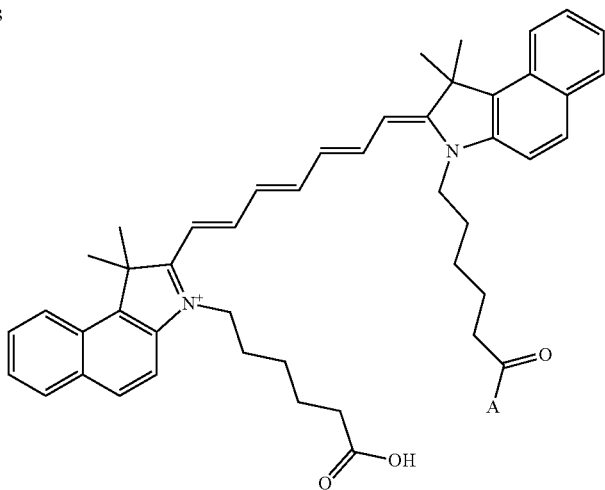
399
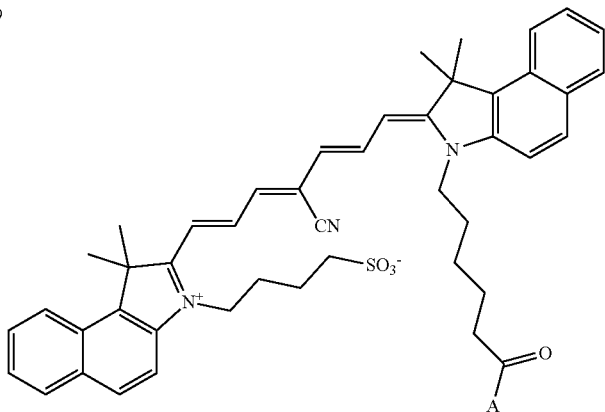

TABLE 8-continued
Exemplary compounds according to the present disclosure.
No. Structure
400
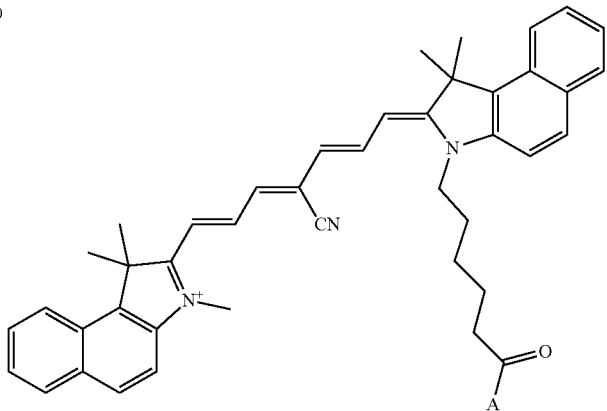
401
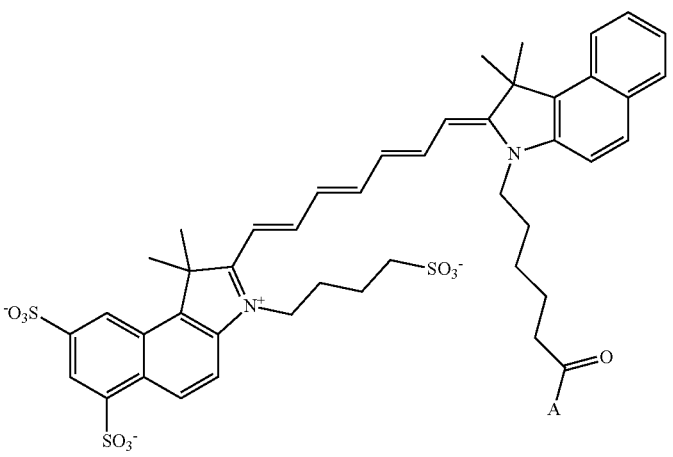
402
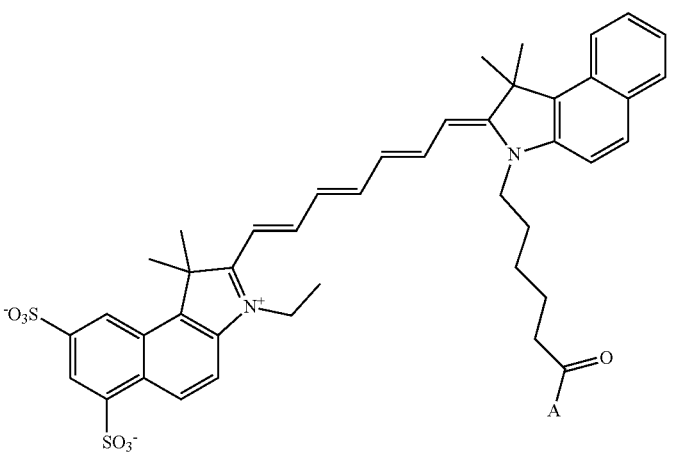

TABLE 8-continued
Exemplary compounds according to the present disclosure.
No. Structure
403 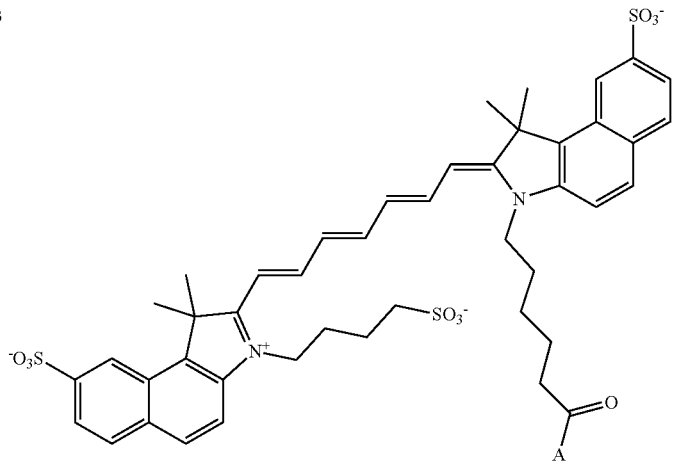
404 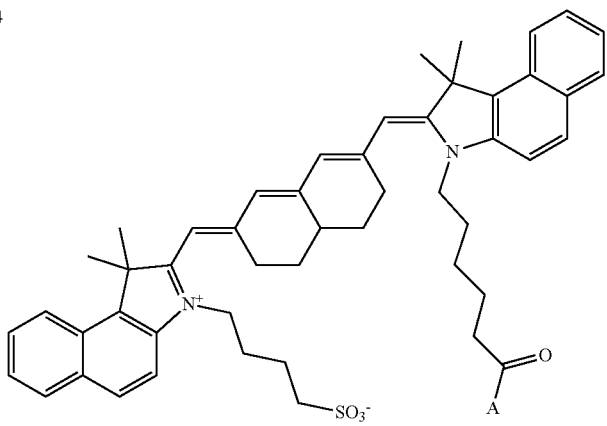
405 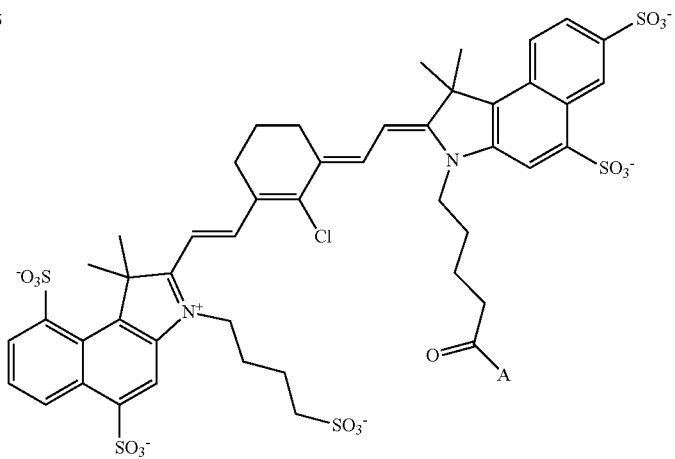

TABLE 8-continued
Exemplary compounds according to the present disclosure.
No. Structure
406
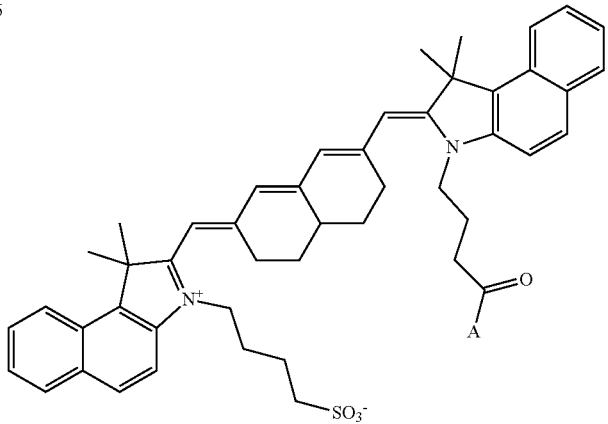
407
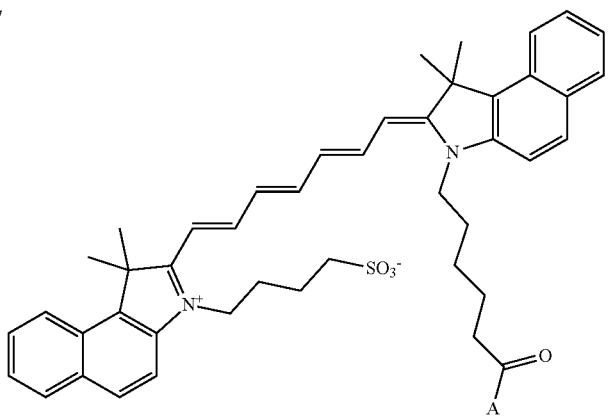
408
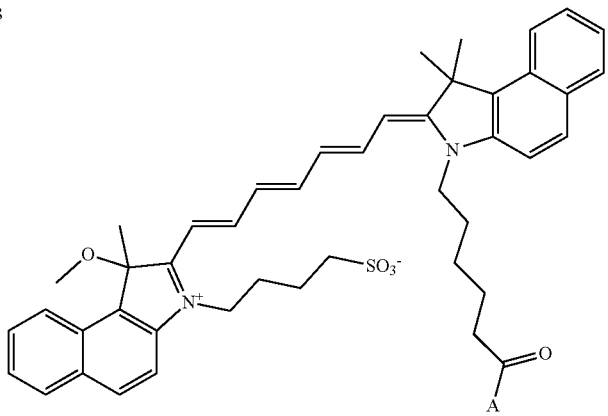

TABLE 8-continued
Exemplary compounds according to the present disclosure.
No. Structure
409
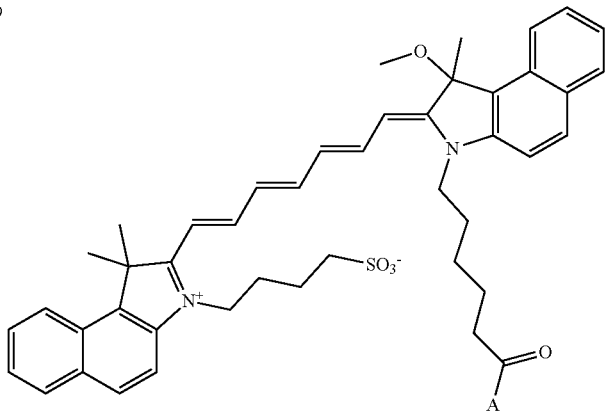
410
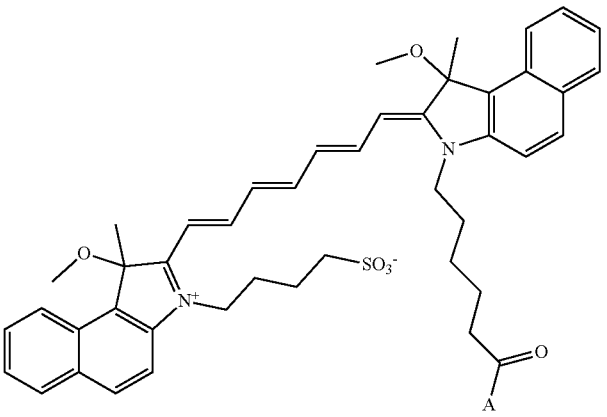
711
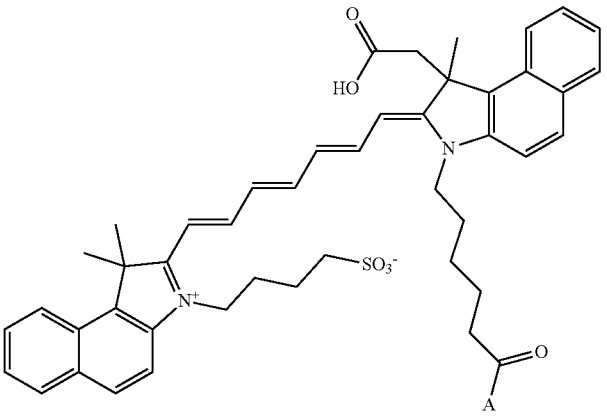

TABLE 8-continued
Exemplary compounds according to the present disclosure.
No. Structure
712 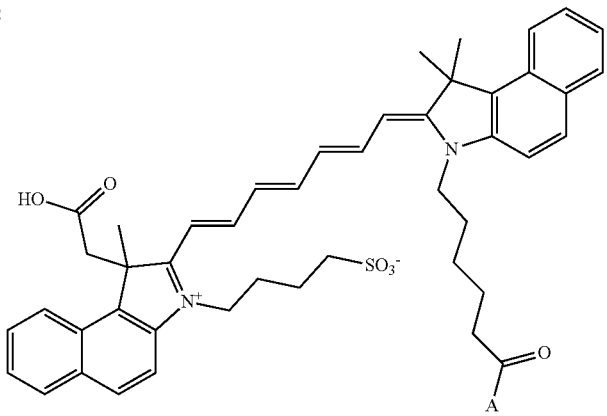
713 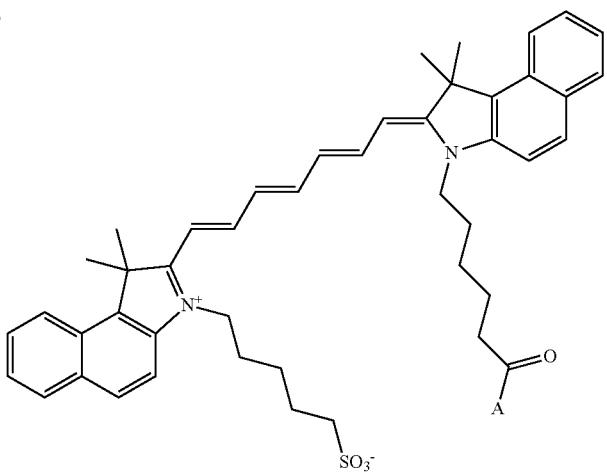
714 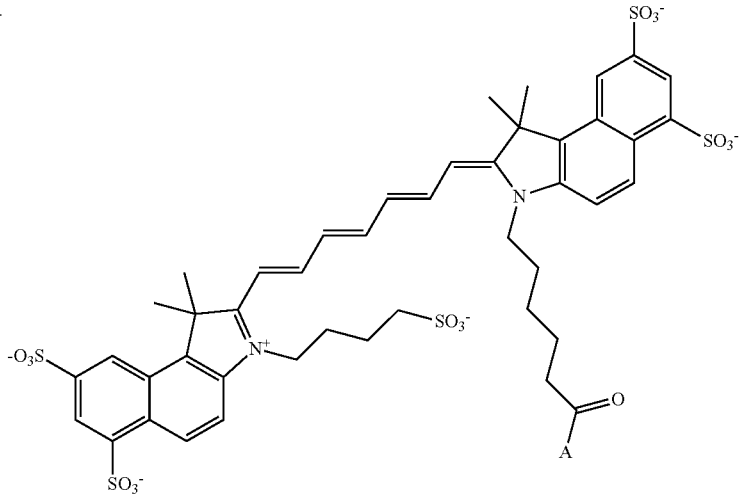

TABLE 8-continued
Exemplary compounds according to the present disclosure.
No. Structure
715
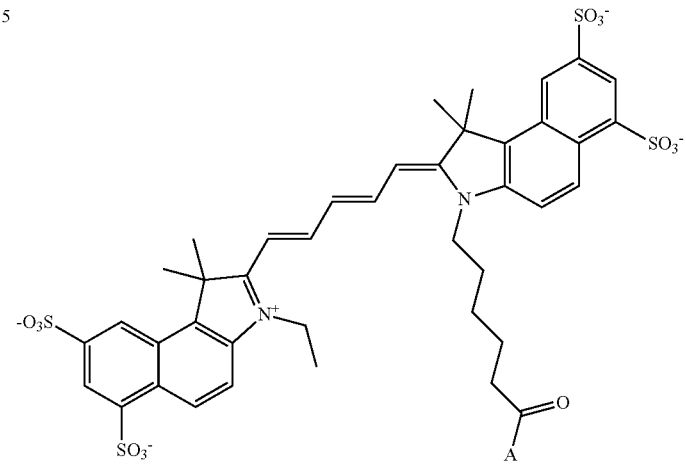
716
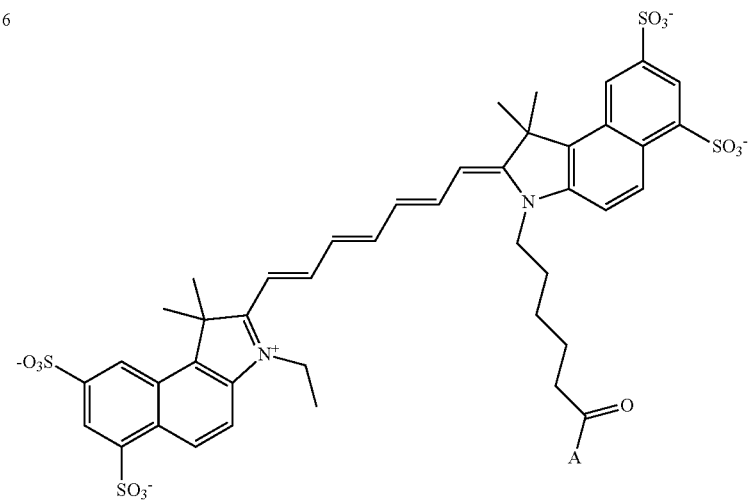
717
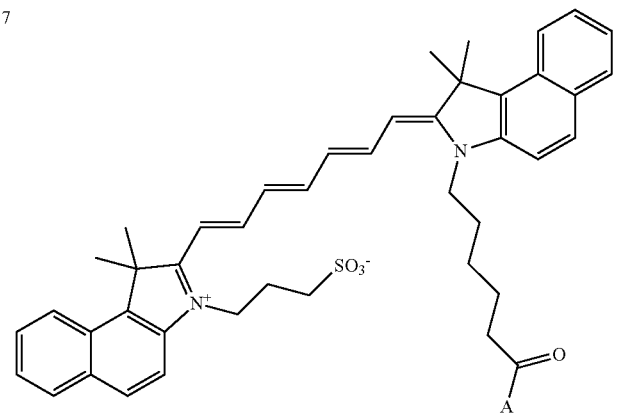

TABLE 8-continued
Exemplary compounds according to the present disclosure.
No. Structure
718
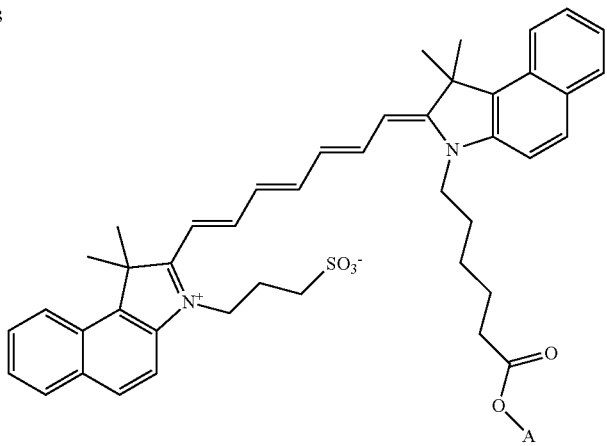
719
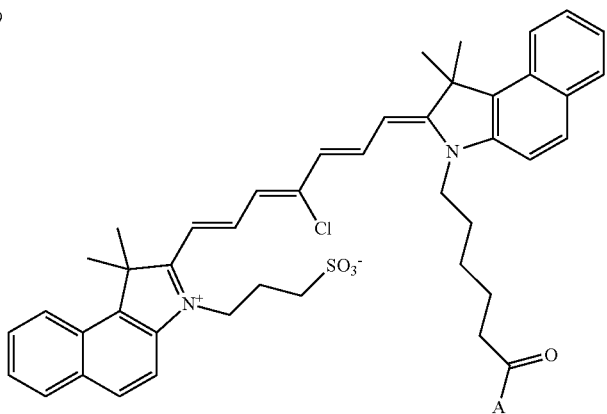
720
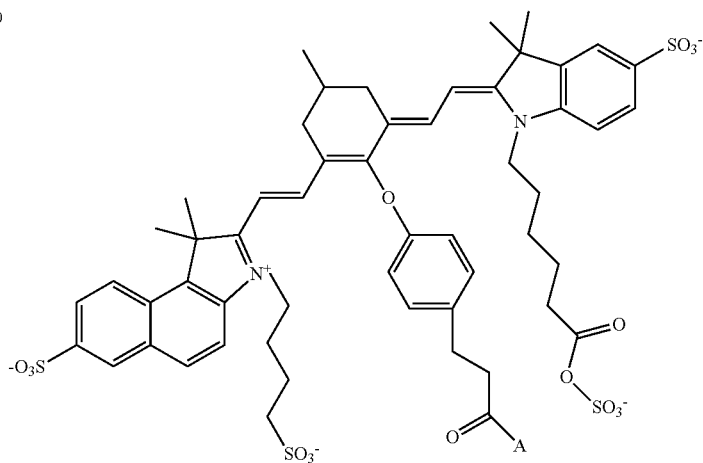
A = MCMPCFTTDHQMARKCDDCCGGAGRGACYGPQCLCR (SEQ ID NO: 13) (attached at K-15)

TABLE 9
Exemplary compounds according to the present disclosure.
No.  Structure
411
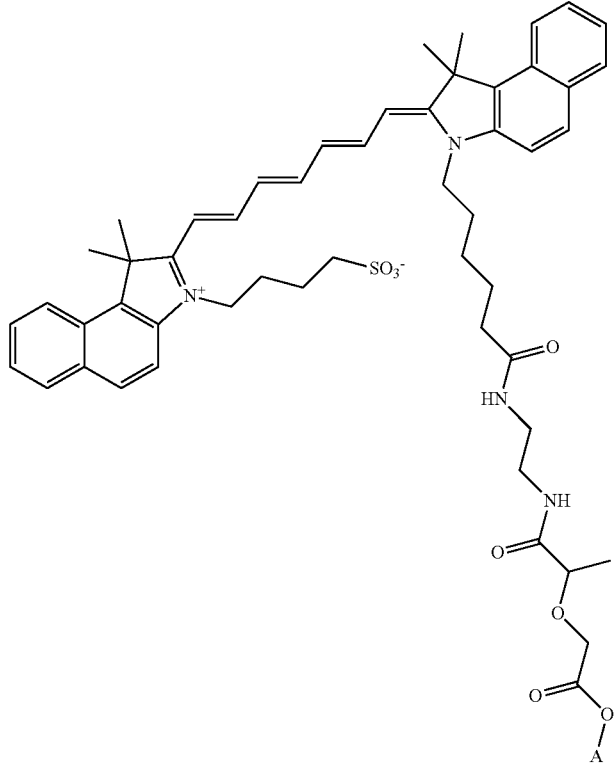
412
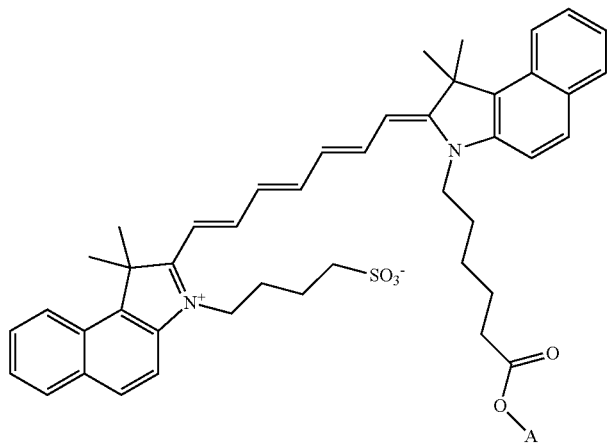

TABLE 9-continued
Exemplary compounds according to the present disclosure.
| No. | Structure |
|---|---|
| 413 | 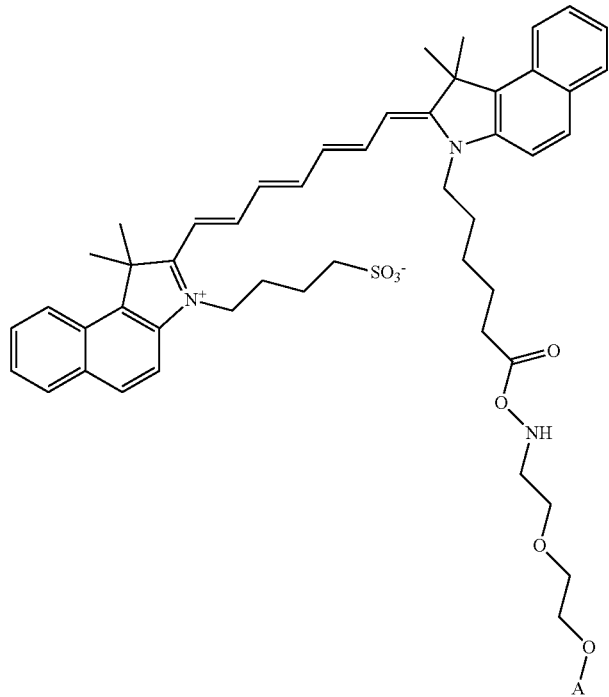 |
| 414 | 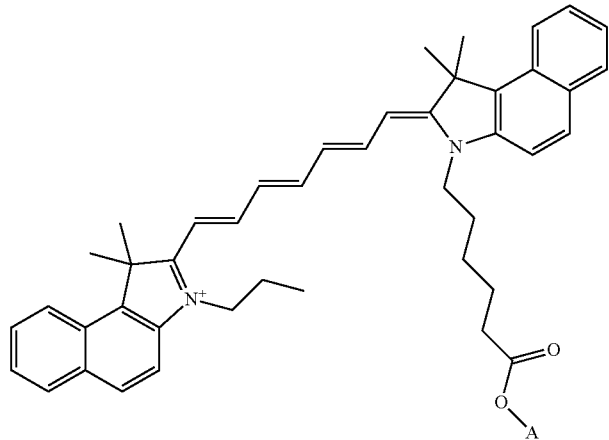 |
| 415 | 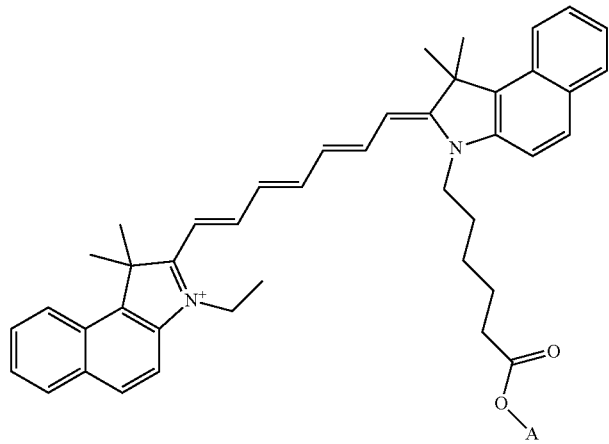 |

TABLE 9-continued
Exemplary compounds according to the present disclosure.
No. Structure
416
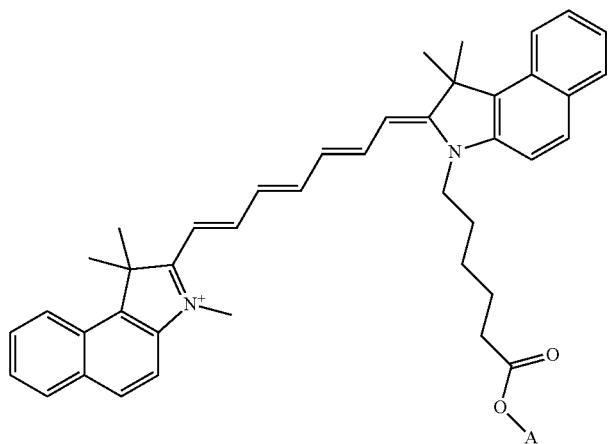
417
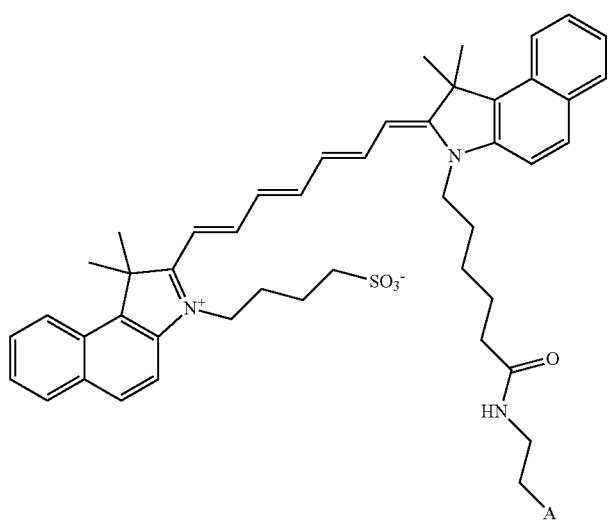
418
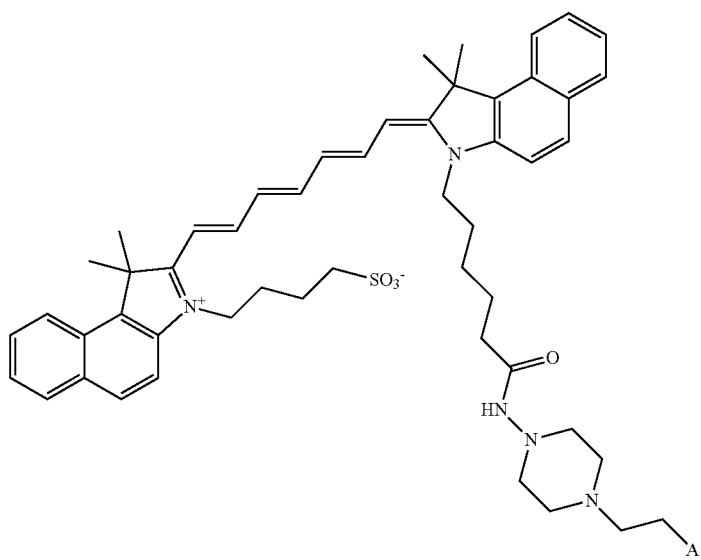

TABLE 9-continued
Exemplary compounds according to the present disclosure.
| No. | Structure |
|---|---|
| 419 | 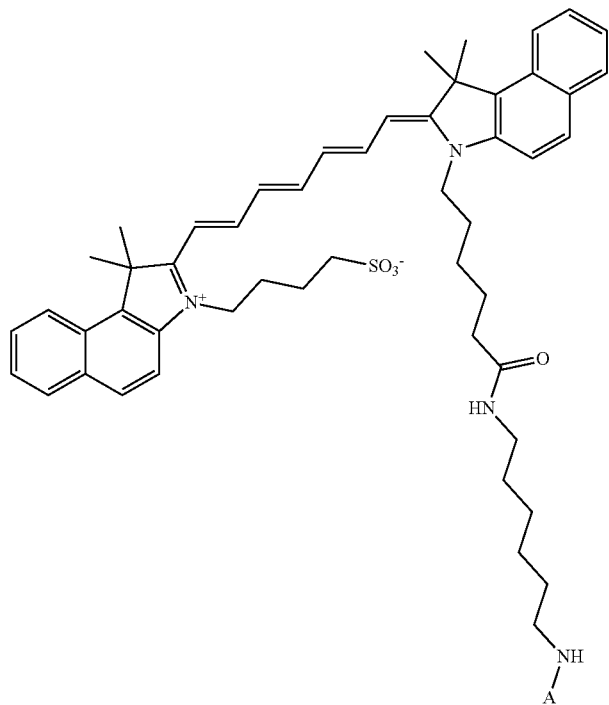 |
| 420 | 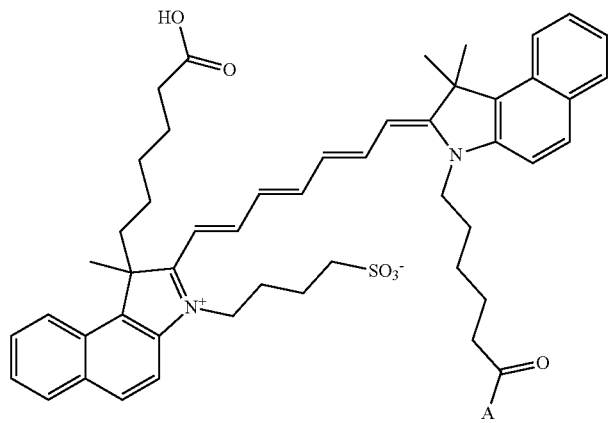 |
| 421 | 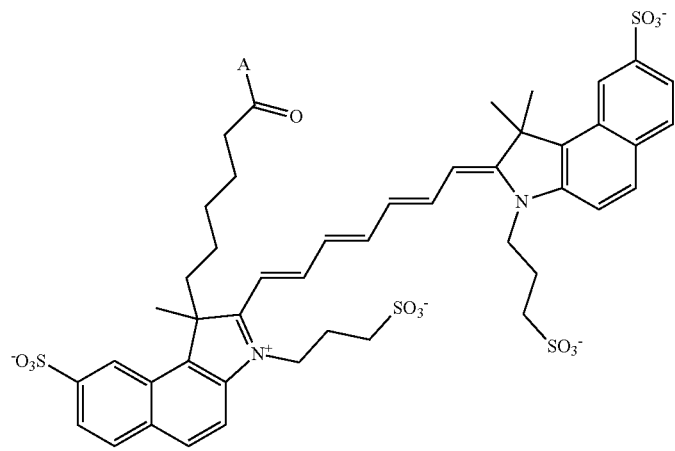 |

TABLE 9-continued
Exemplary compounds according to the present disclosure.
No. Structure
422 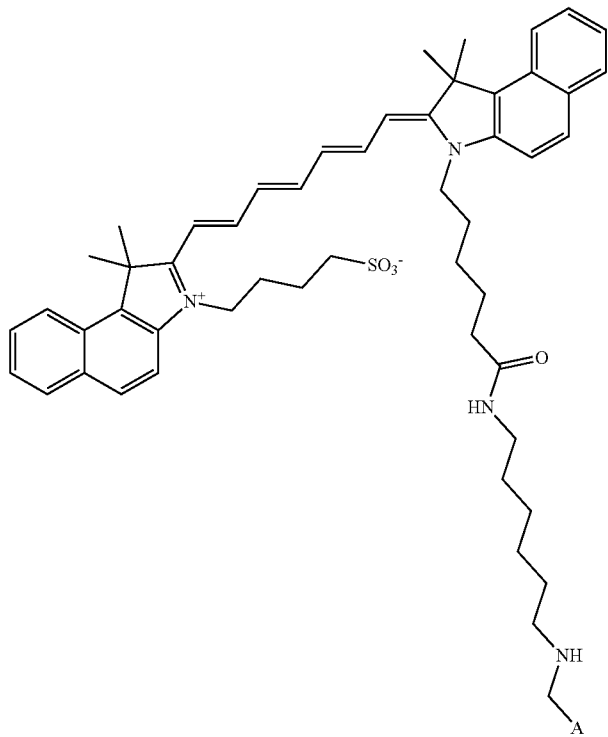

TABLE 9-continued
Exemplary compounds according to the present disclosure.
No. Structure
423
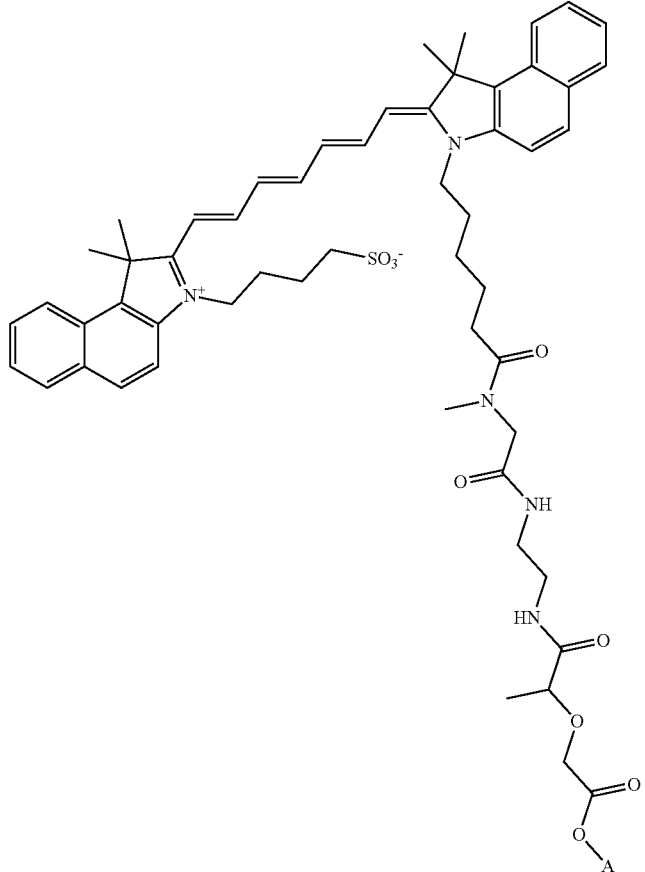
424
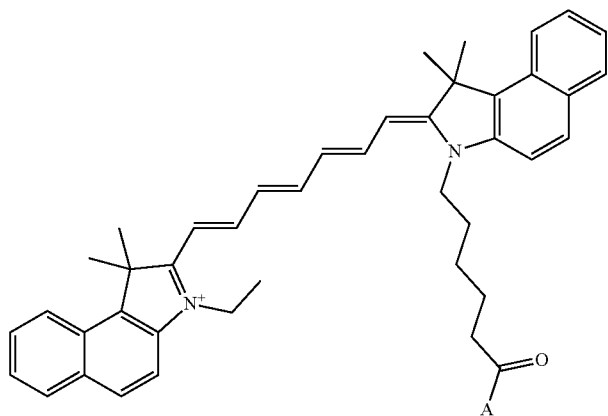

TABLE 9-continued
Exemplary compounds according to the present disclosure.
No. Structure
425
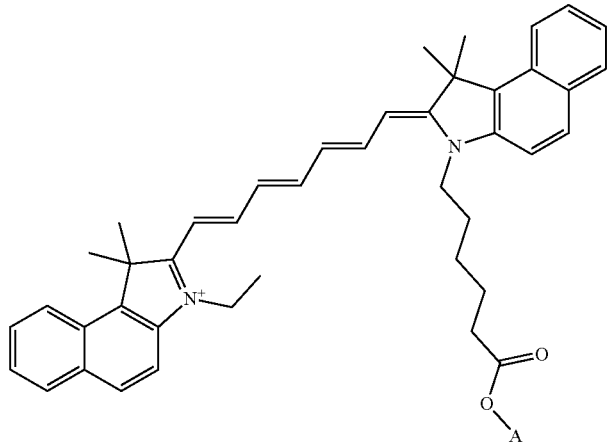
426
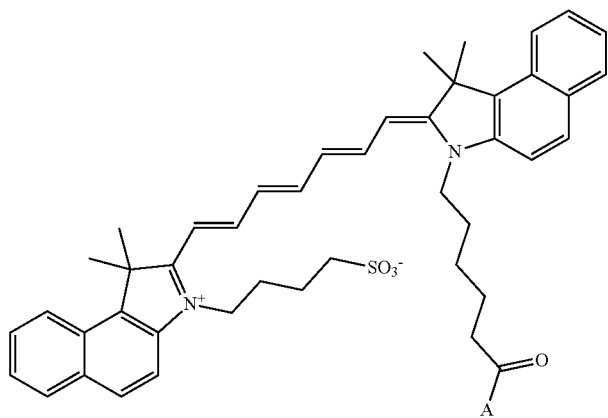
427
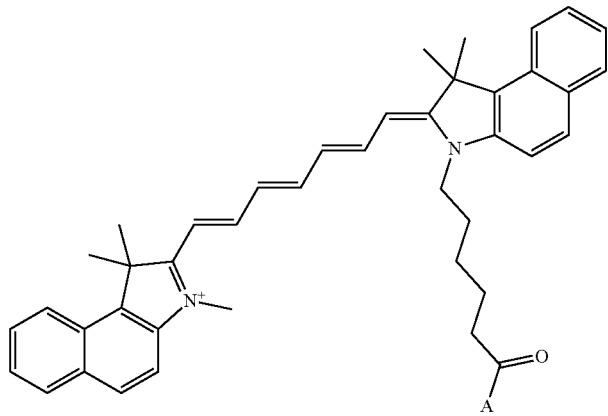

TABLE 9-continued
Exemplary compounds according to the present disclosure.
No. Structure
428
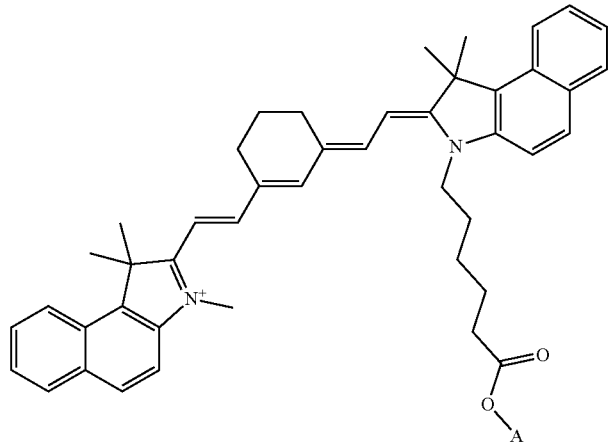
429
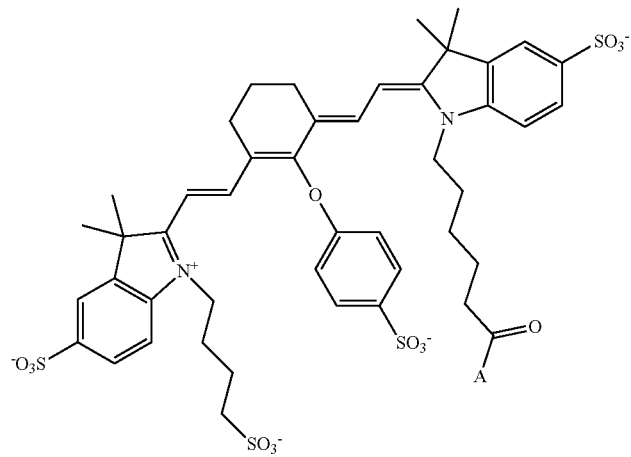
430
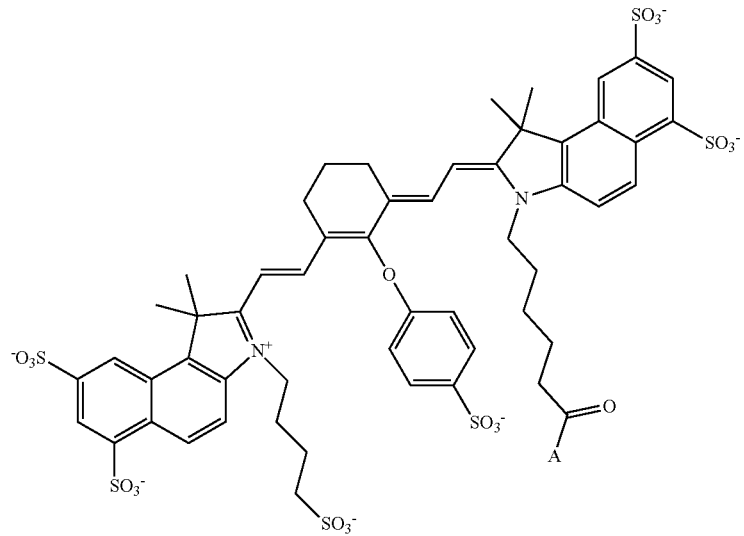

TABLE 9-continued
Exemplary compounds according to the present disclosure.
| No. | Structure |
| --- | --- |
| 431 | 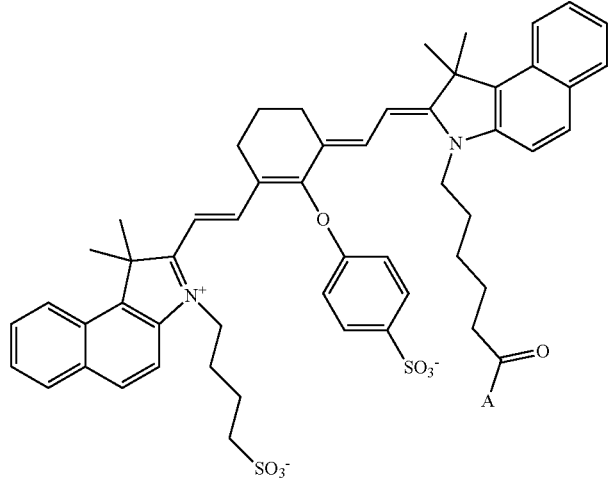 |
| 432 | 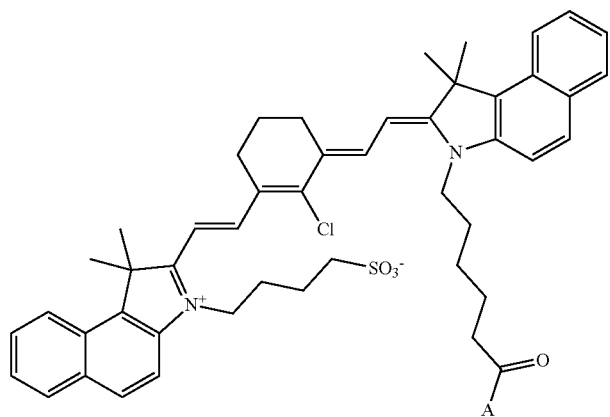 |
| 433 | 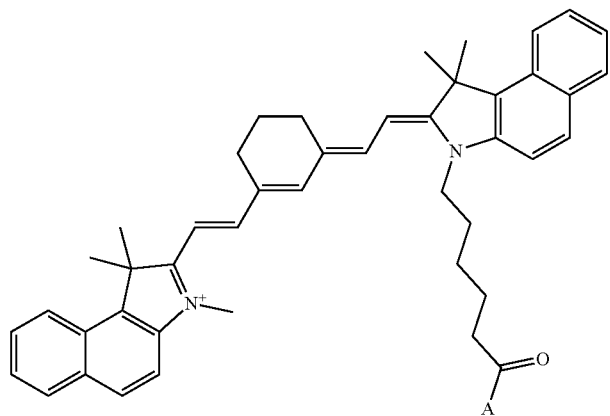 |

TABLE 9-continued
Exemplary compounds according to the present disclosure.
No. Structure
434
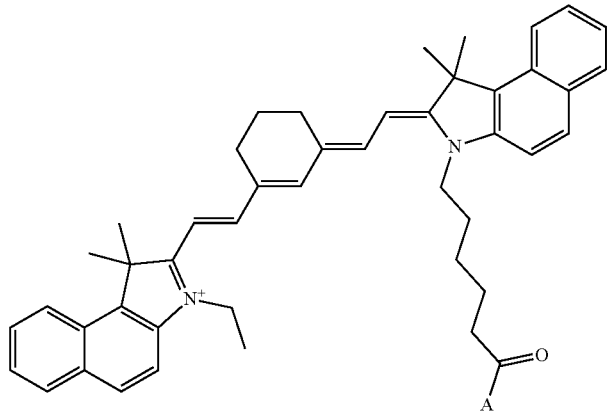
435
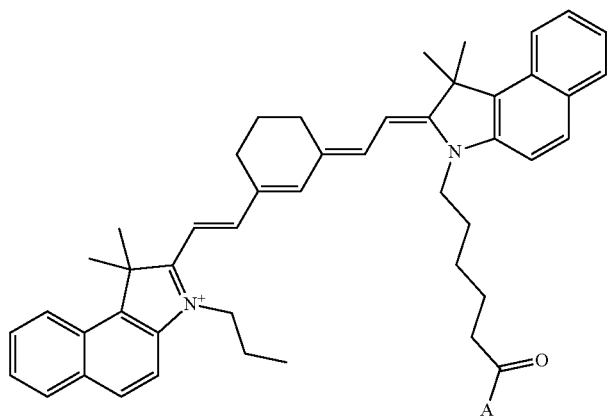
436
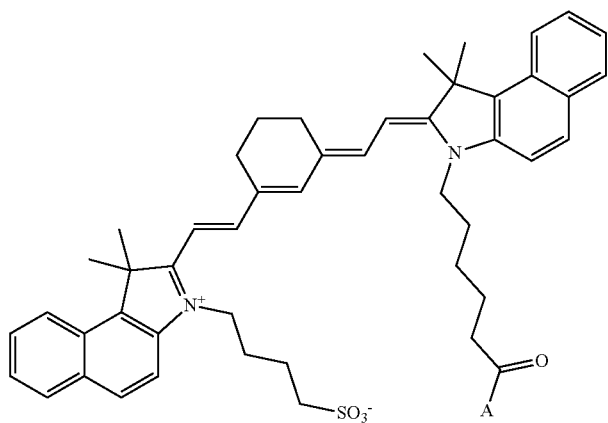

TABLE 9-continued
Exemplary compounds according to the present disclosure.
| No. | Structure |
|---|---|
| 437 | 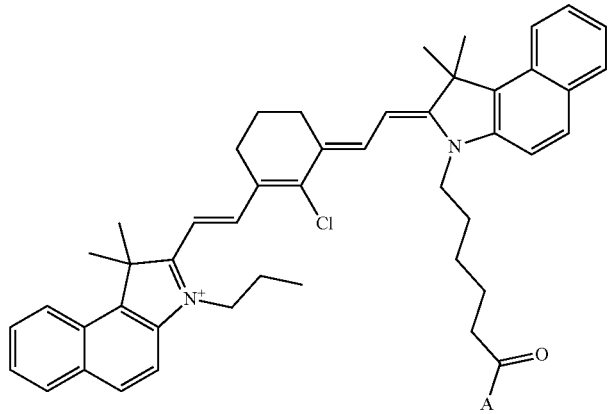 |
| 438 | 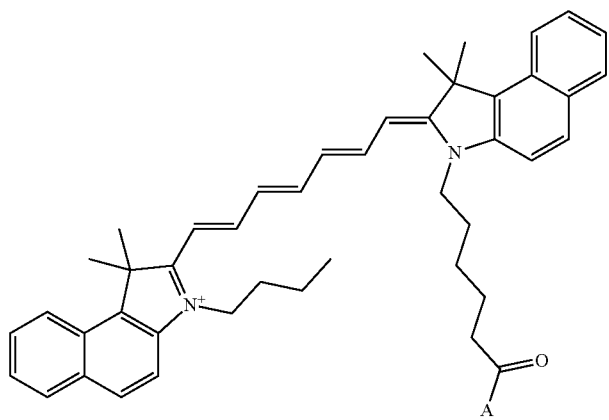 |
| 439 | 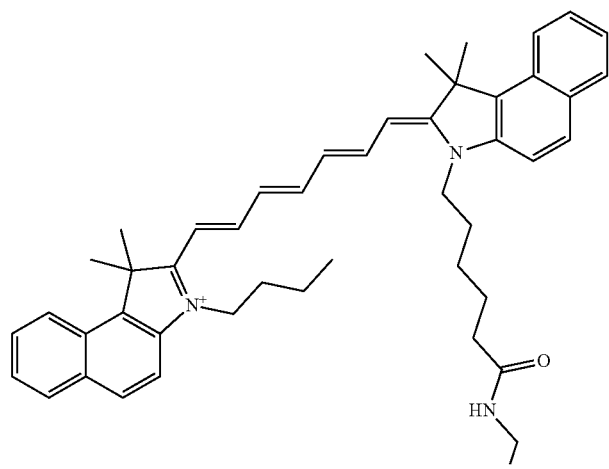 |

505
506
TABLE 9-continued
Exemplary compounds according to the present disclosure.
No. Structure
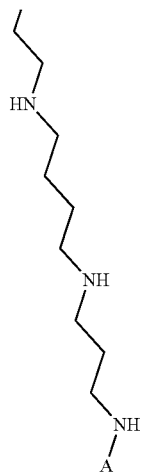
440
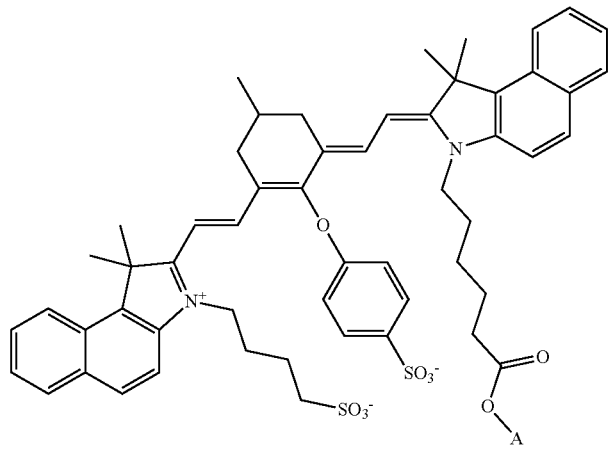
441
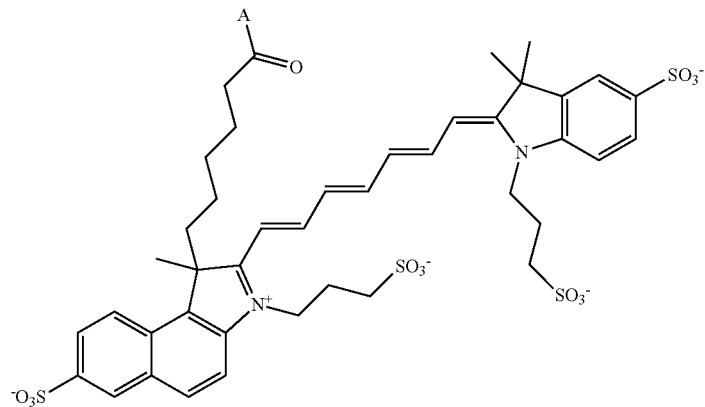

TABLE 9-continued
Exemplary compounds according to the present disclosure.
No. Structure
442
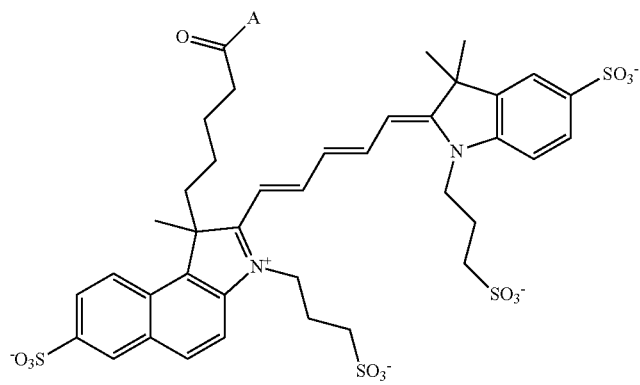
443
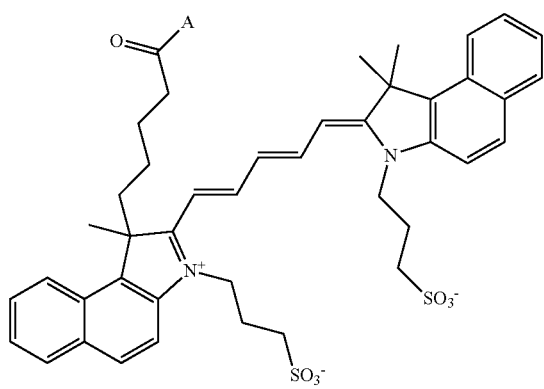
444
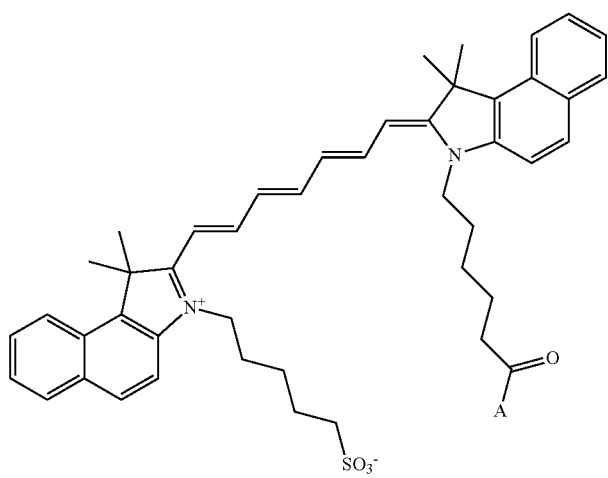

TABLE 9-continued
Exemplary compounds according to the present disclosure.
No. Structure
445
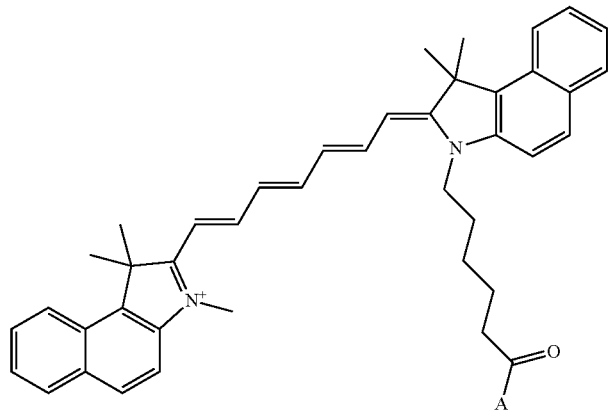
446
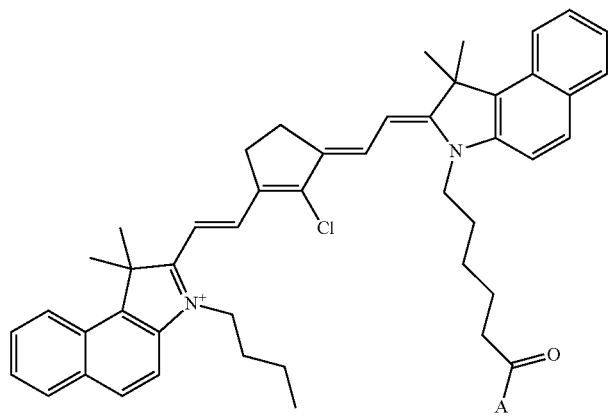
447
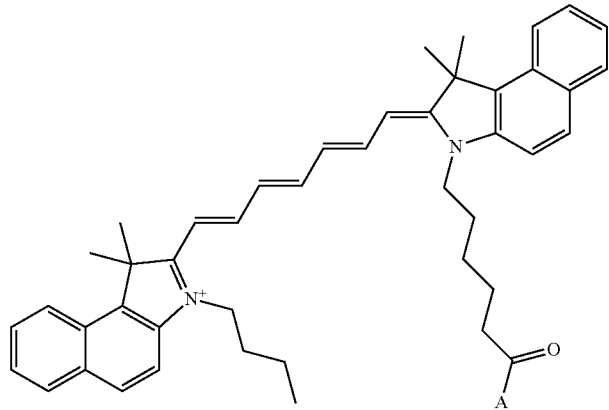

TABLE 9-continued
Exemplary compounds according to the present disclosure.
No. Structure
448
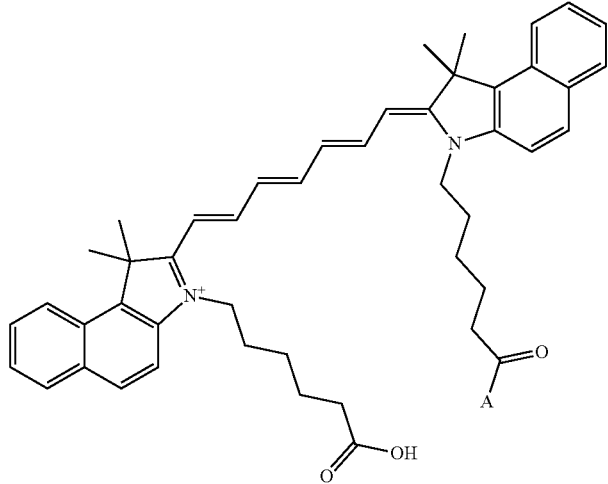
449
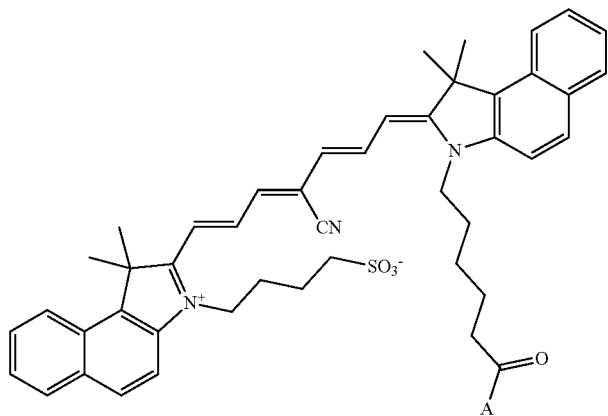
450
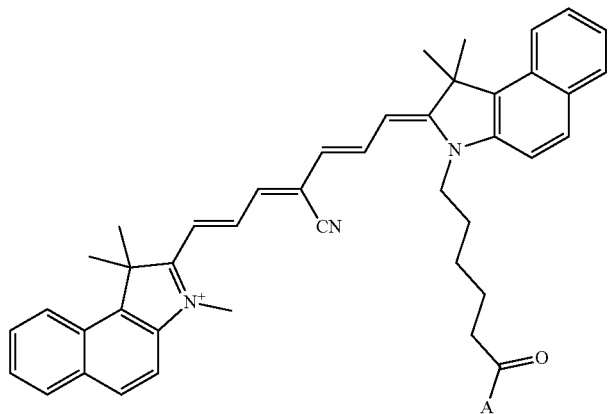

TABLE 9-continued
Exemplary compounds according to the present disclosure.
No. Structure
451
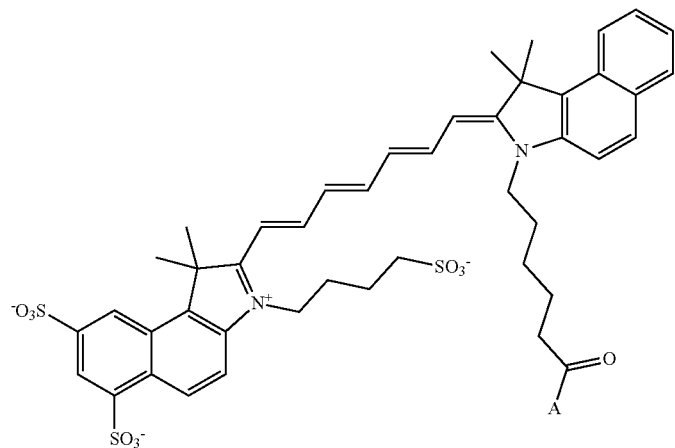
452
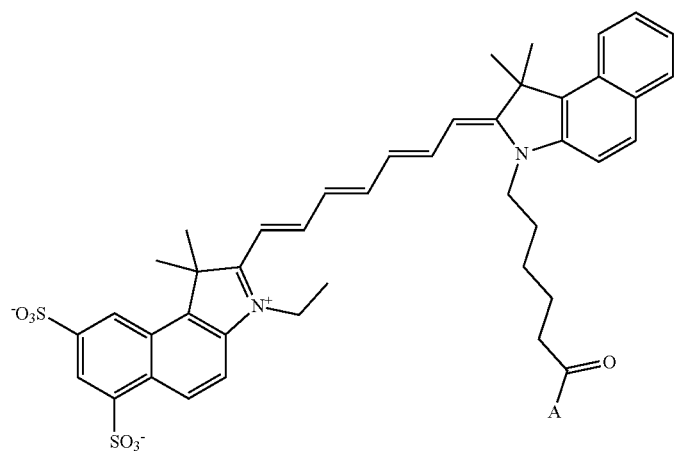
453
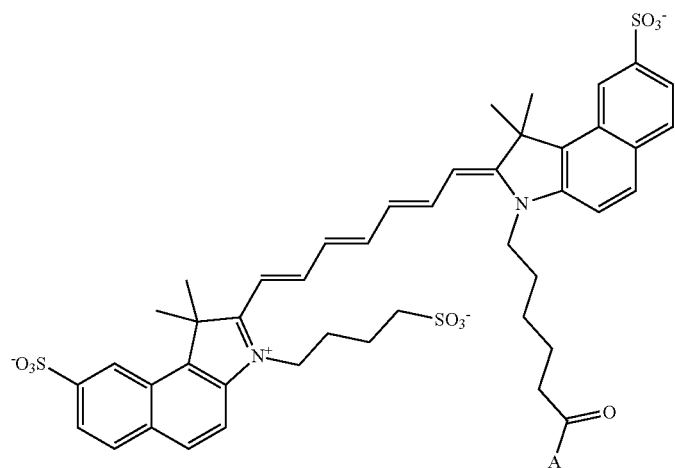

TABLE 9-continued
Exemplary compounds according to the present disclosure.
No. Structure
454
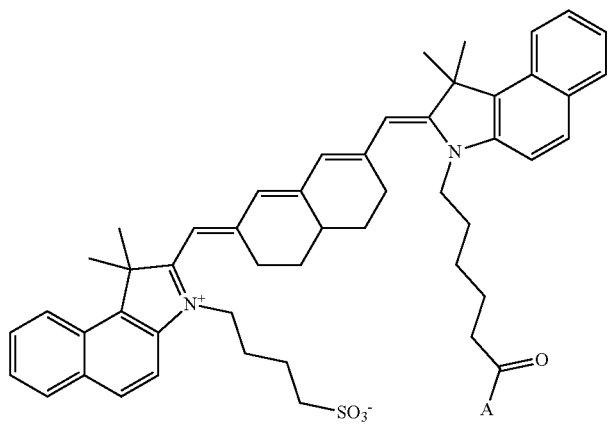
455
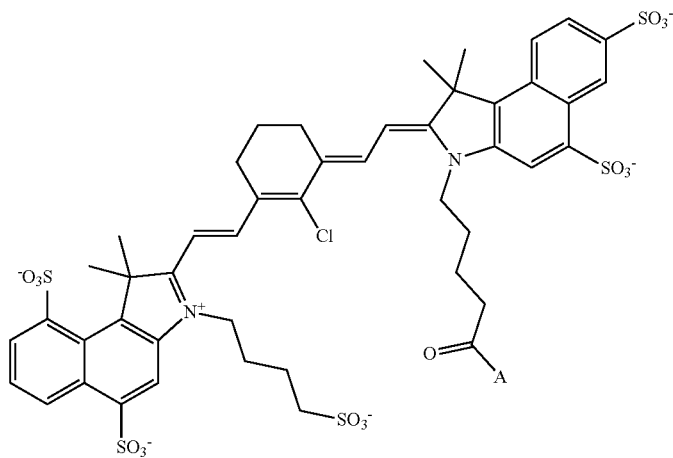
456
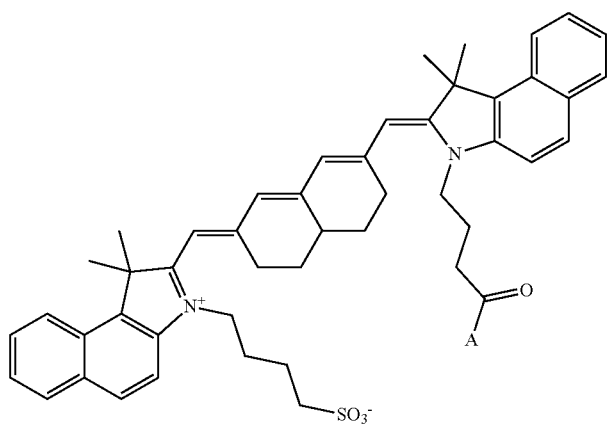

TABLE 9-continued
Exemplary compounds according to the present disclosure.
No. Structure
457
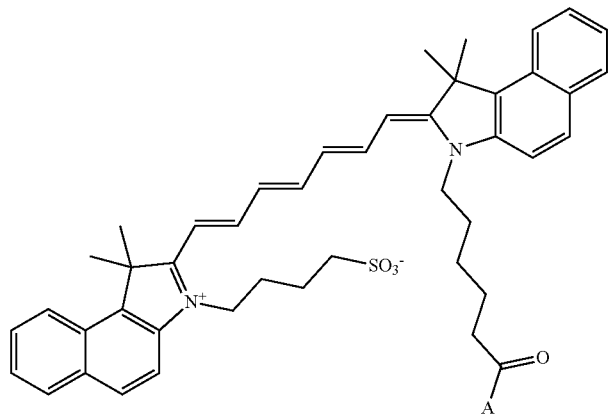
458
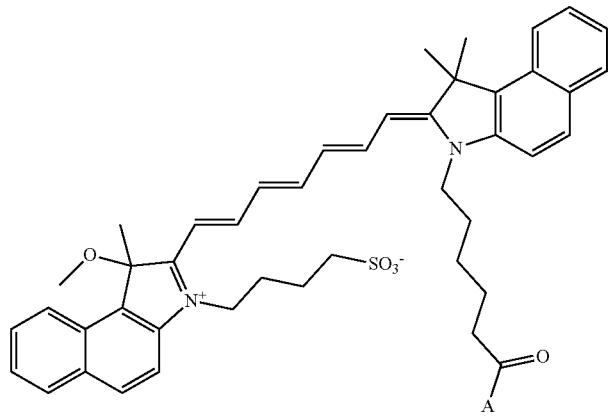
459
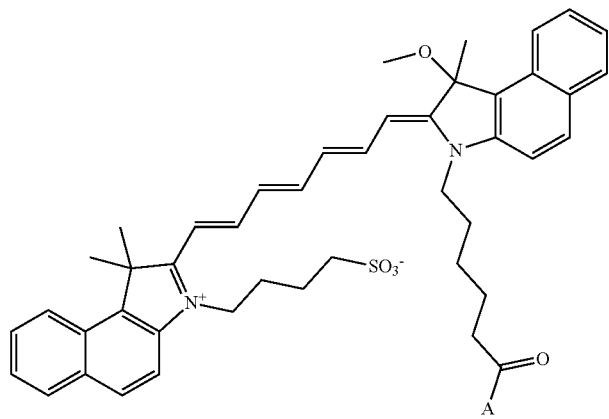

TABLE 9-continued
Exemplary compounds according to the present disclosure.
No.   Structure
460
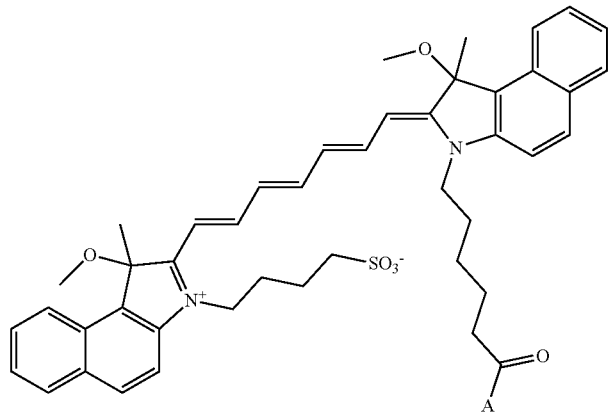
461
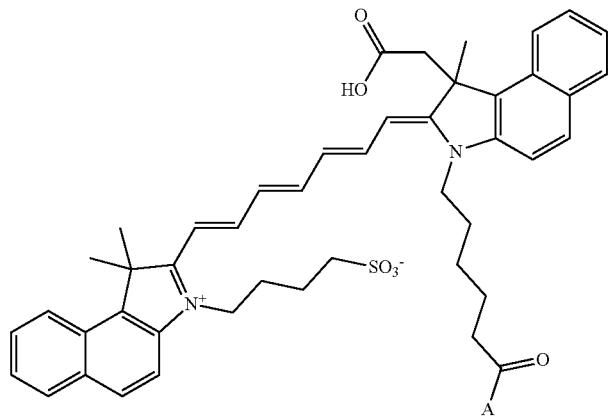
462
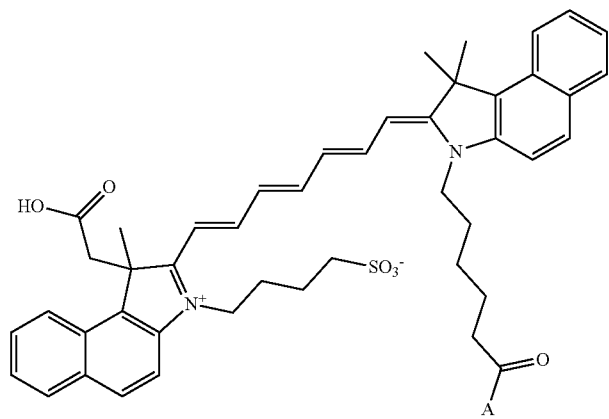

TABLE 9-continued
Exemplary compounds according to the present disclosure.
| No. | Structure |
|-----|-----------|
| 463 | 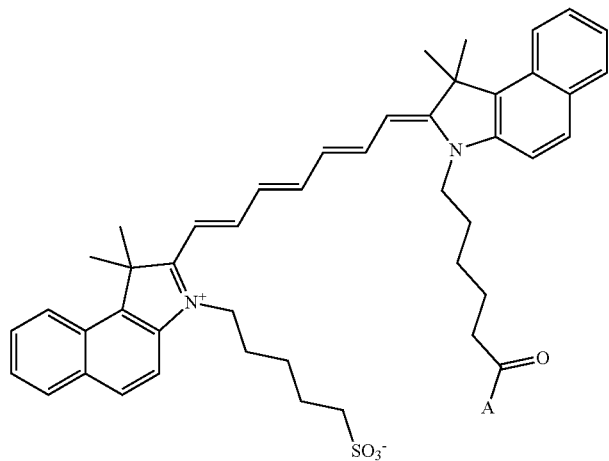 |
| 464 | 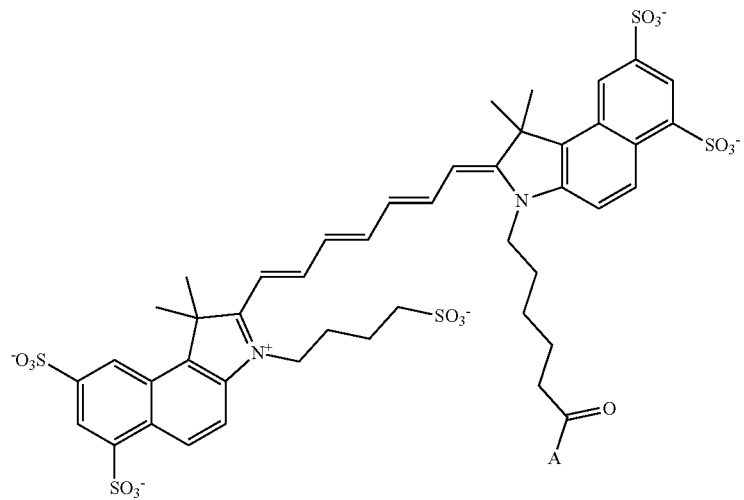 |
| 465 | 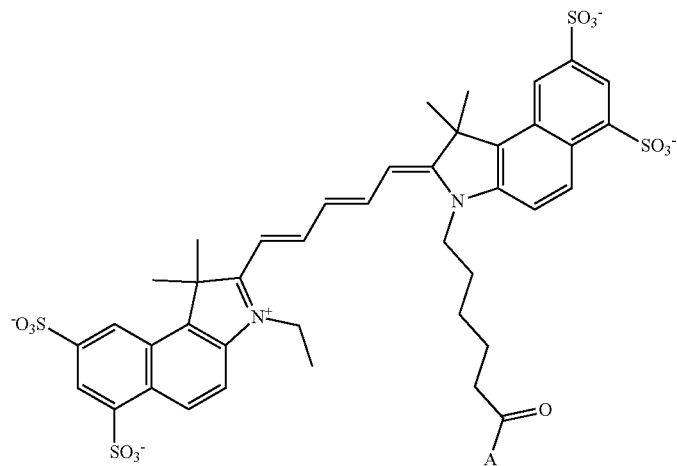 |

TABLE 9-continued
Exemplary compounds according to the present disclosure.
| No. | Structure |
| --- | --- |
| 466 | 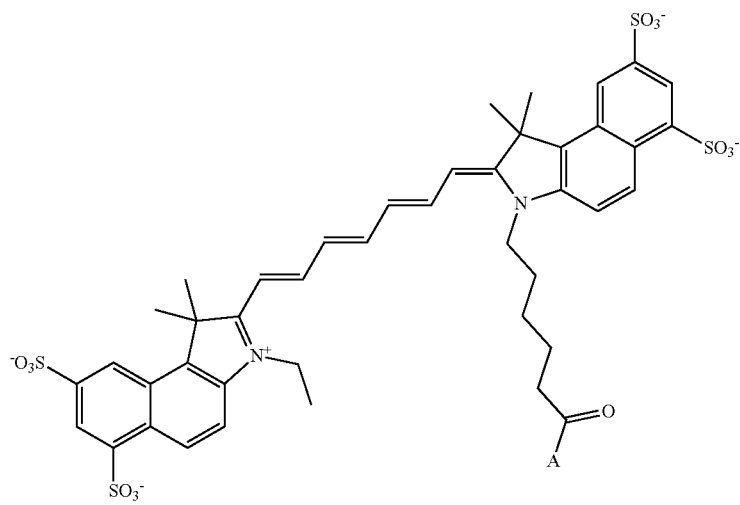 |
| 467 | 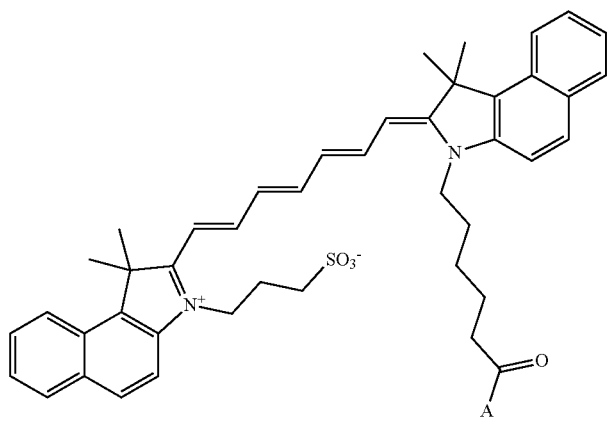 |
| 468 | 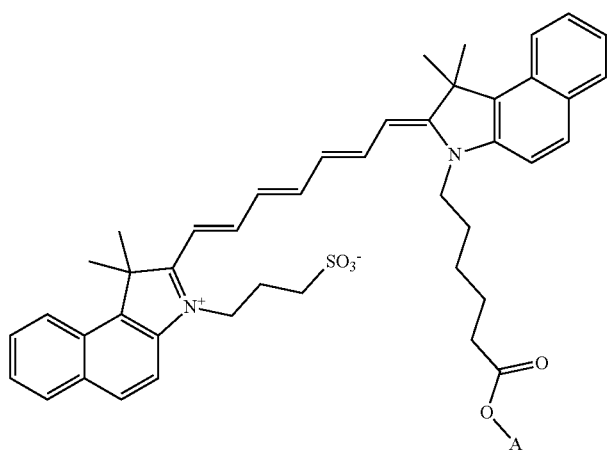 |

TABLE 9-continued
Exemplary compounds according to the present disclosure.
No. Structure
469
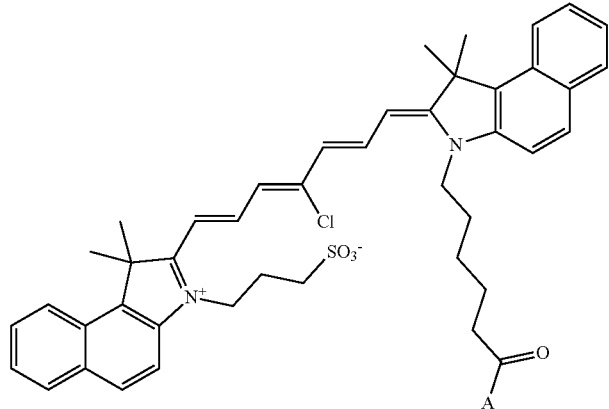
470
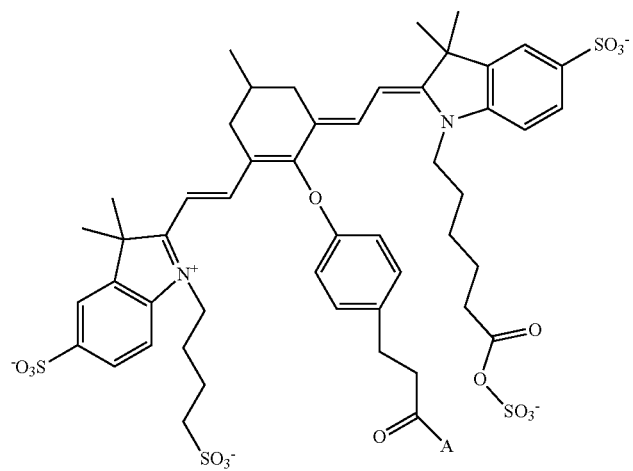
A = MCMPCFTTDHQMARKCDDCCGGRGRGACYGPQCLCR (SEQ ID NO: 16) (attached at K-15)

TABLE 10
Exemplary compounds according to the present disclosure.
No. Structure
471
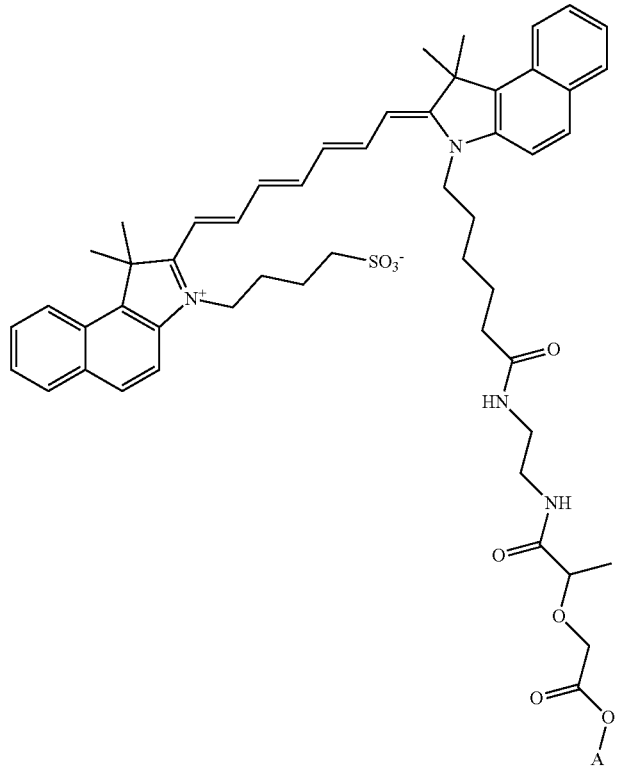
472
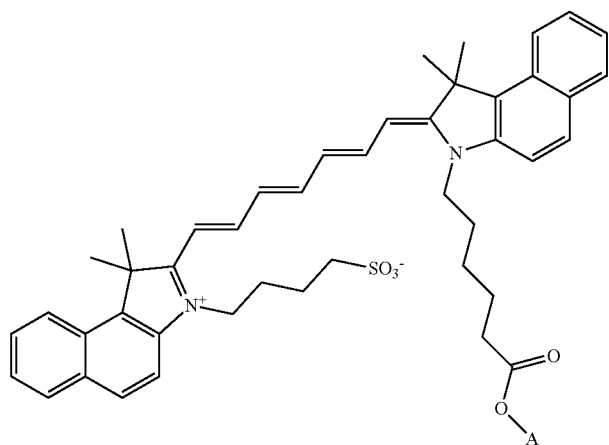

TABLE 10-continued
Exemplary compounds according to the present disclosure.
No. Structure
473 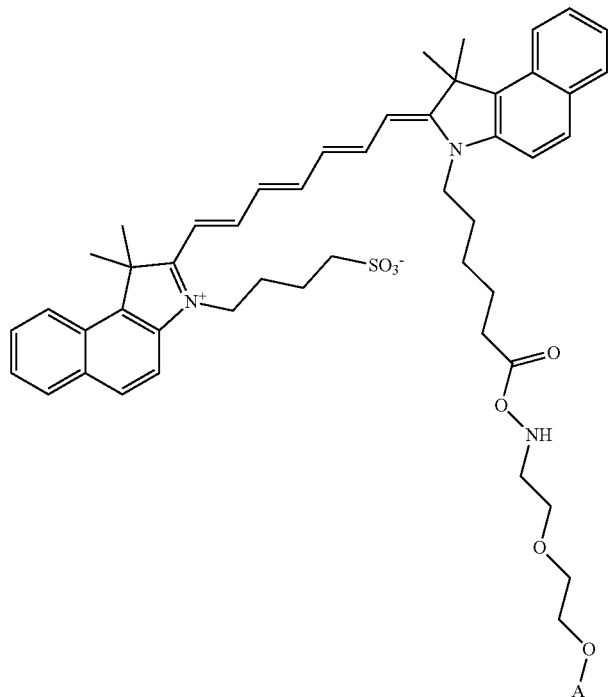
474 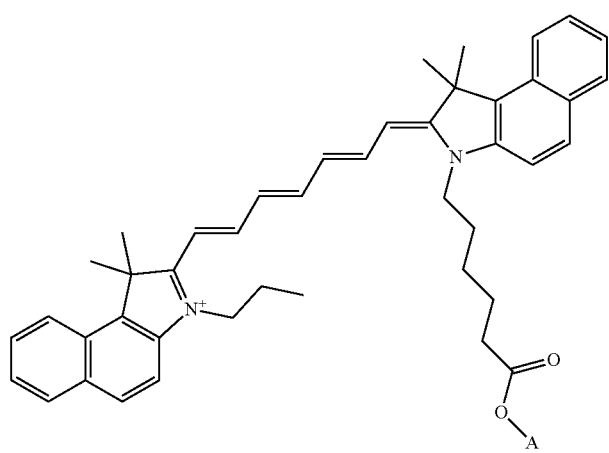
475 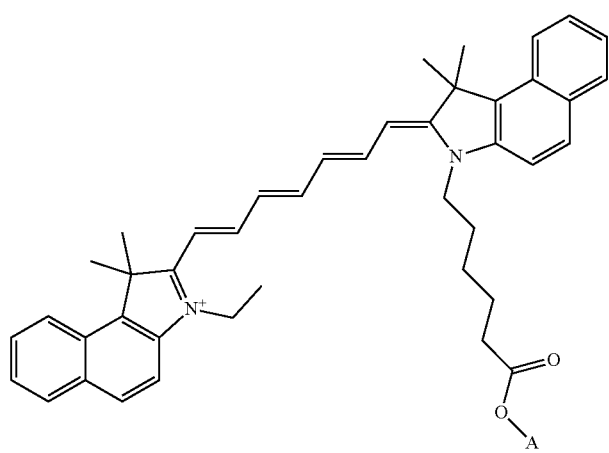

TABLE 10-continued
Exemplary compounds according to the present disclosure.
No. Structure
476
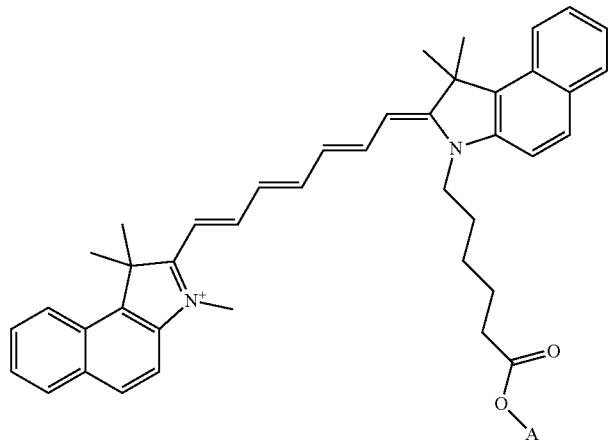
477
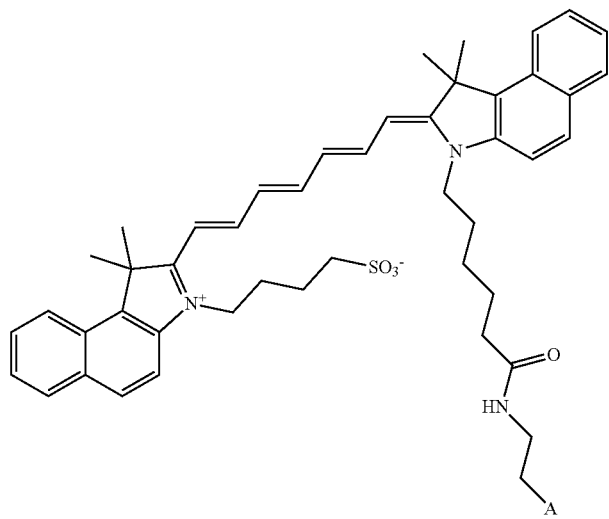
478
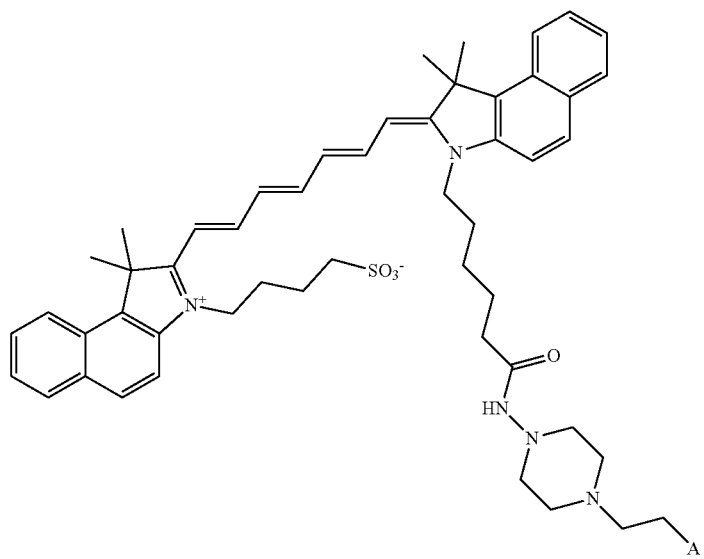

TABLE 10-continued
Exemplary compounds according to the present disclosure.
No. Structure
479
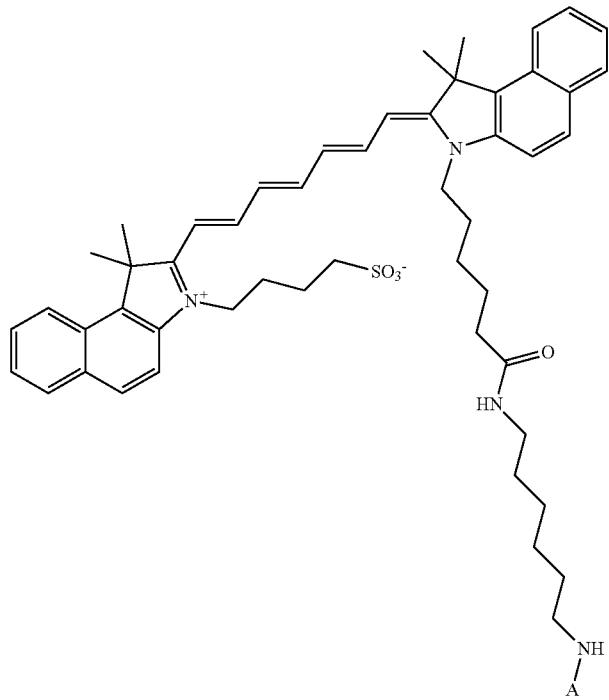
480
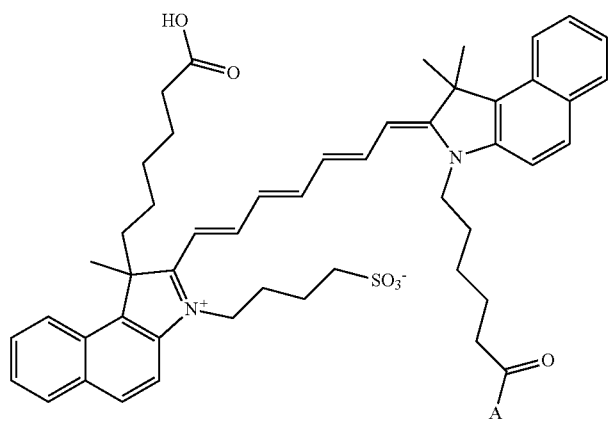
481
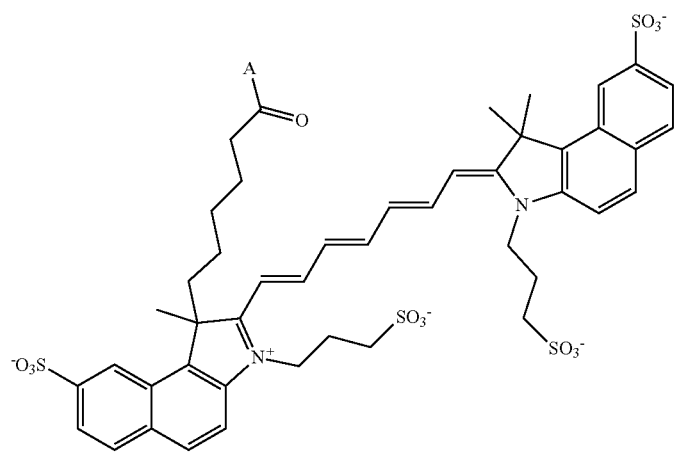

TABLE 10-continued
Exemplary compounds according to the present disclosure.
No. Structure
482
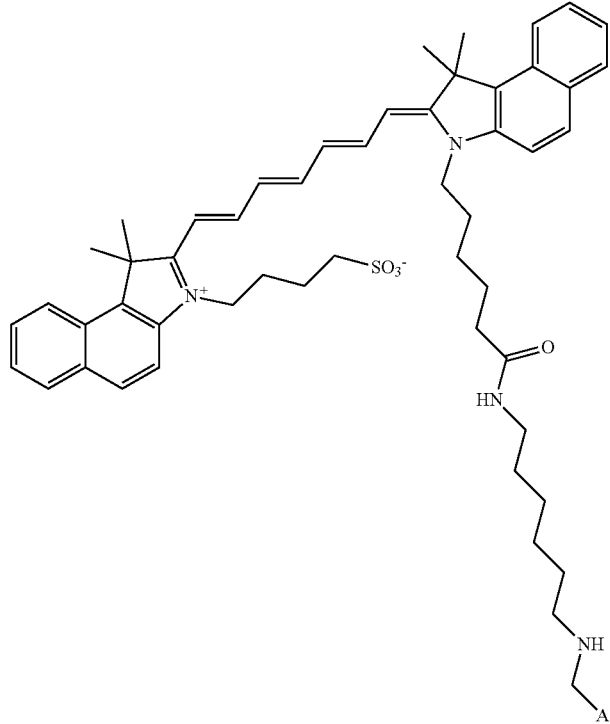
483
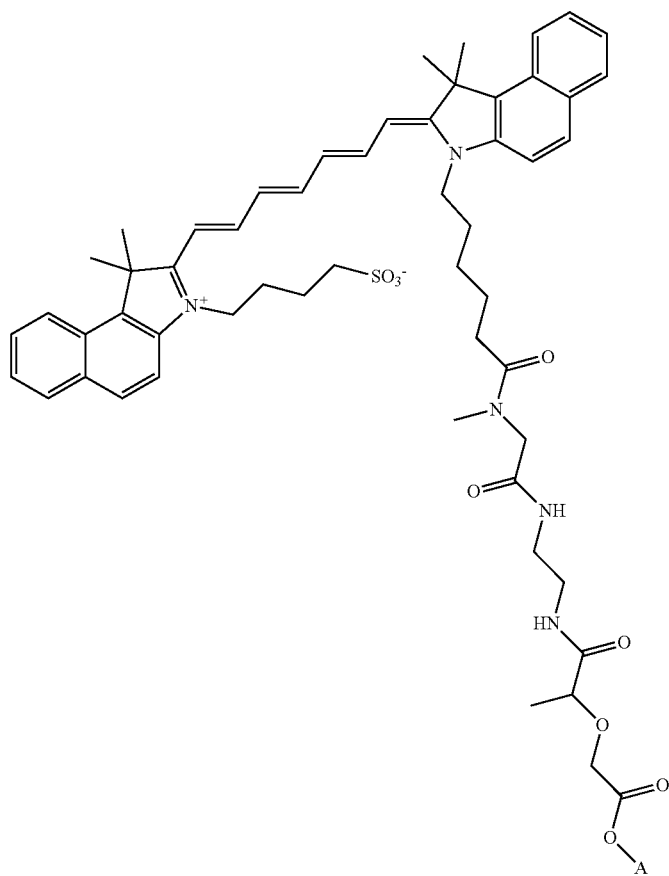

TABLE 10-continued
Exemplary compounds according to the present disclosure.
No. Structure
484
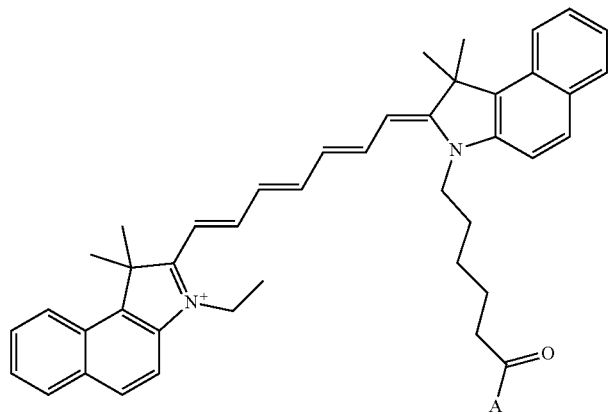
485
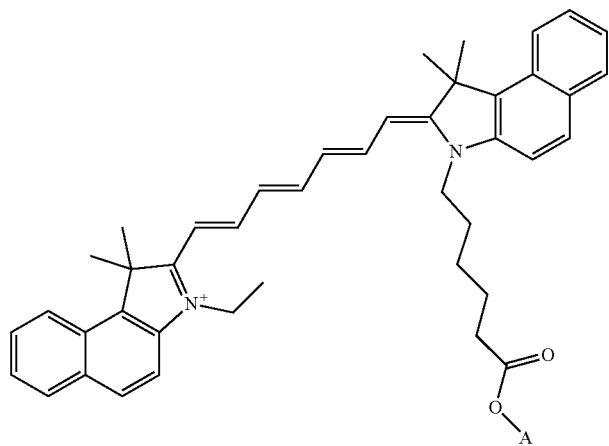
486
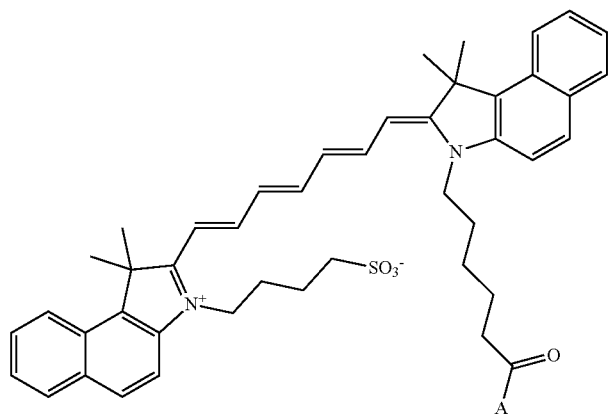

TABLE 10-continued
Exemplary compounds according to the present disclosure.
No. Structure
487
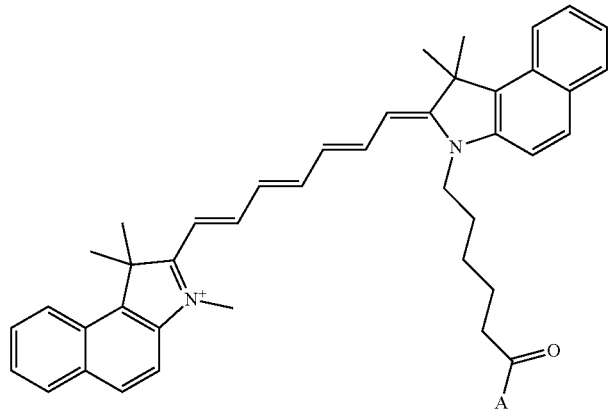
488
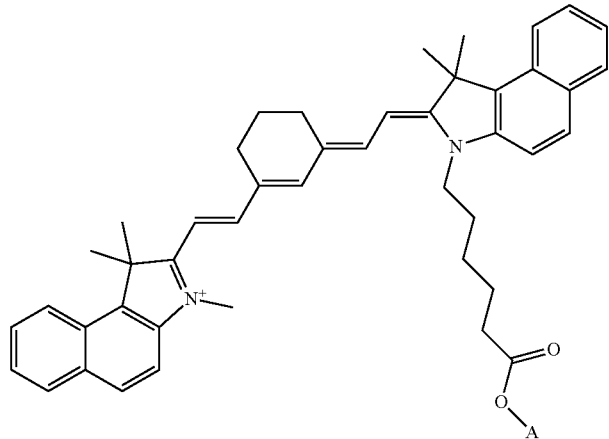
489
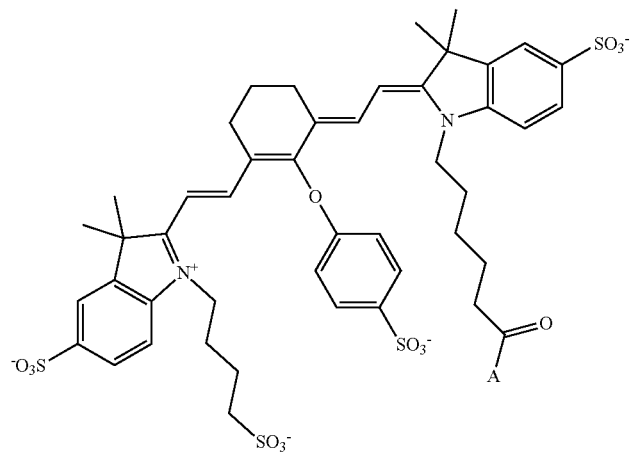

TABLE 10-continued
Exemplary compounds according to the present disclosure.
No. Structure
490
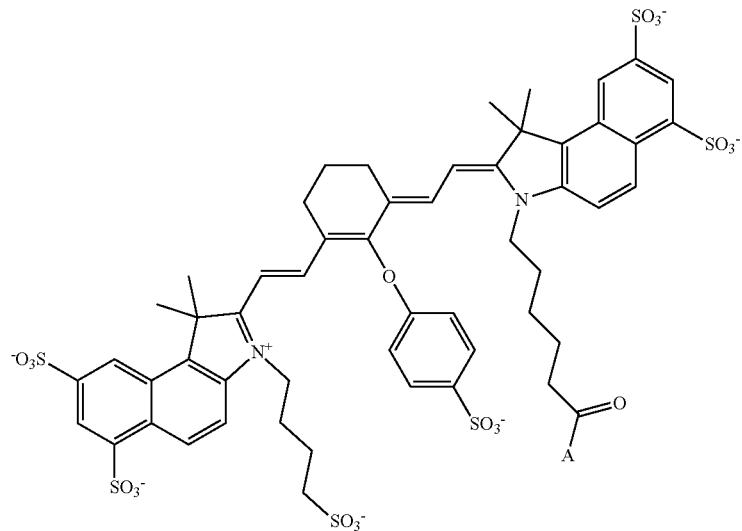
491
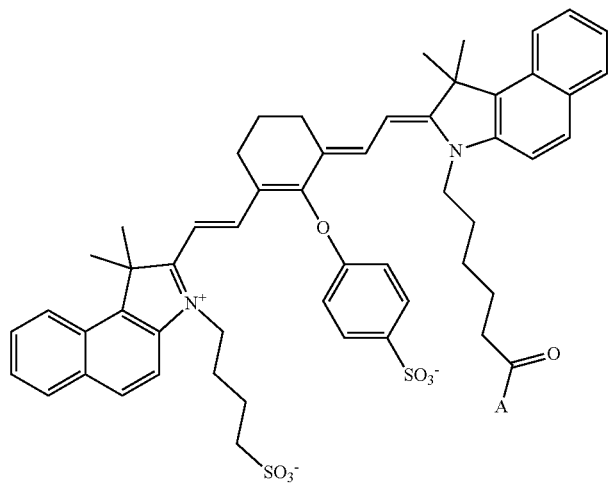
492
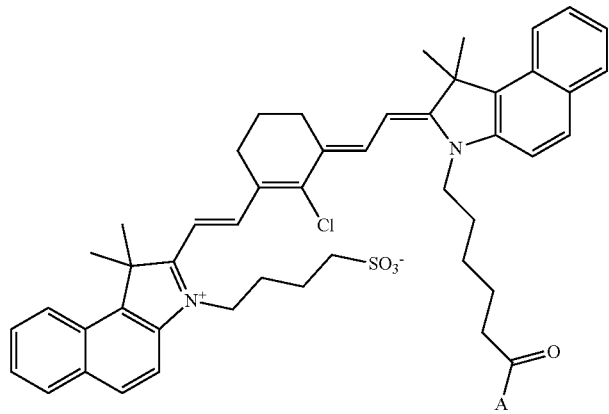

TABLE 10-continued
Exemplary compounds according to the present disclosure.
No. Structure
493
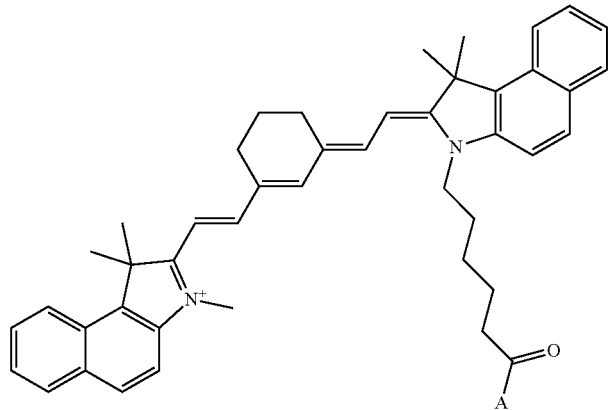
494
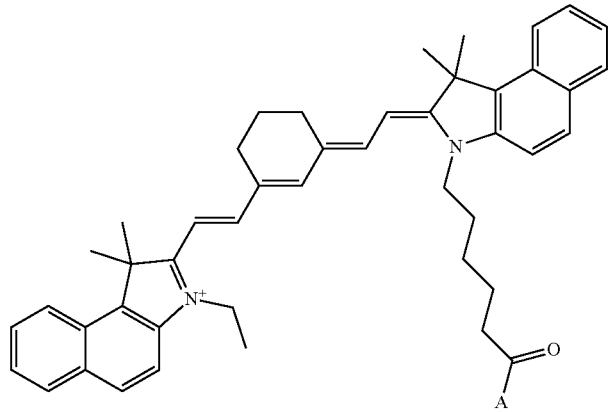
495
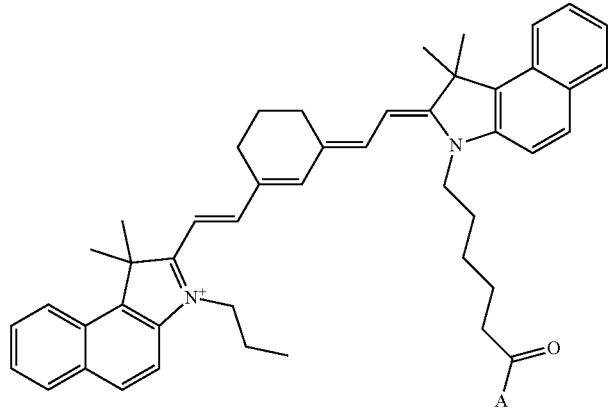

TABLE 10-continued
Exemplary compounds according to the present disclosure.
No. Structure
496
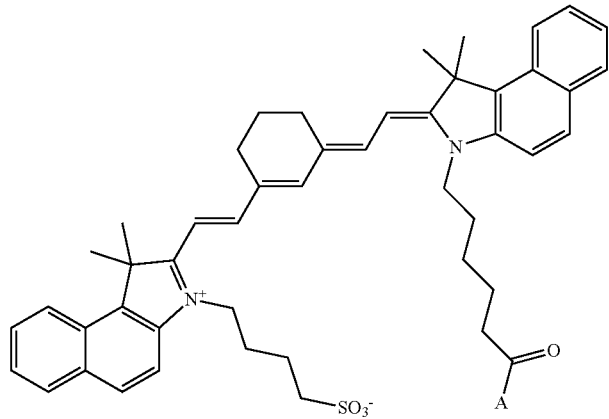
497
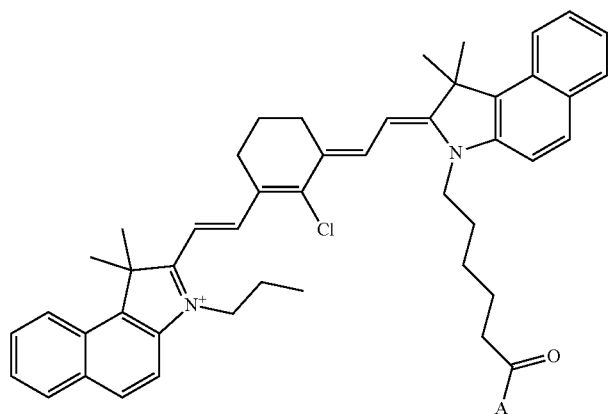
498
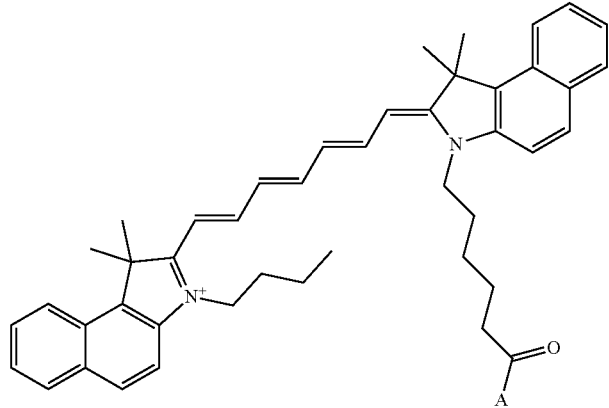

TABLE 10-continued
Exemplary compounds according to the present disclosure.
No. Structure
499
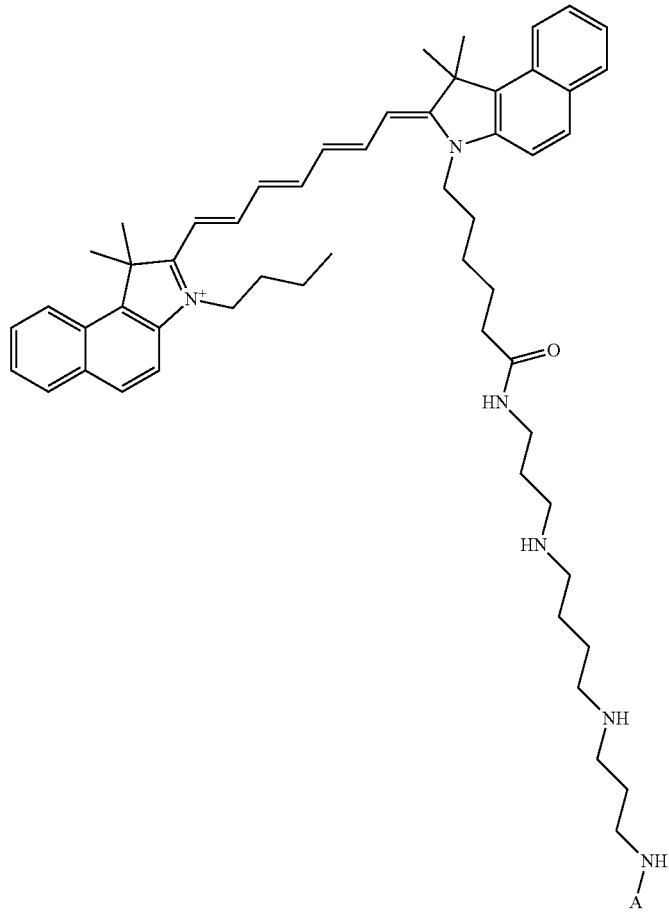
500
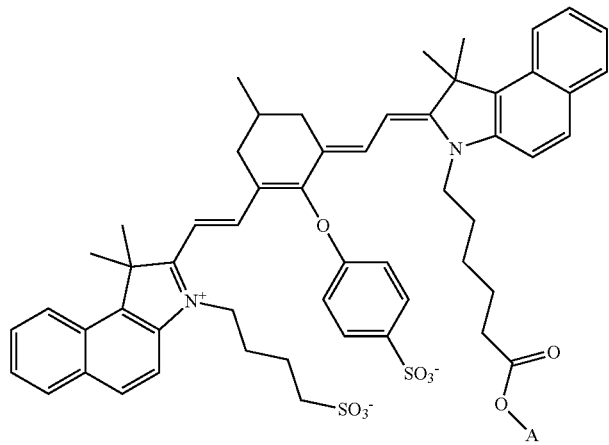

TABLE 10-continued
Exemplary compounds according to the present disclosure.
No. Structure
501 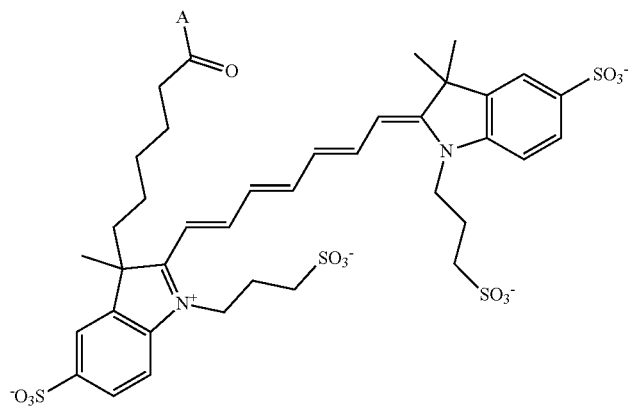
502 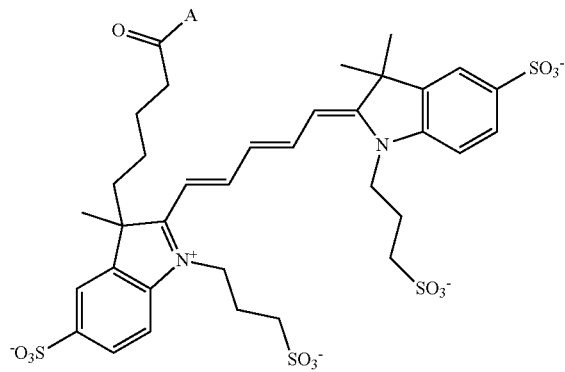
503 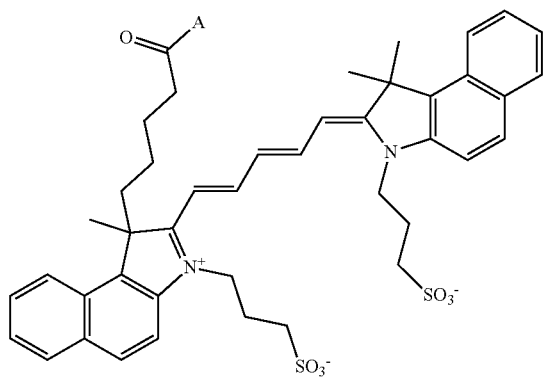

TABLE 10-continued
Exemplary compounds according to the present disclosure.
No. Structure
504
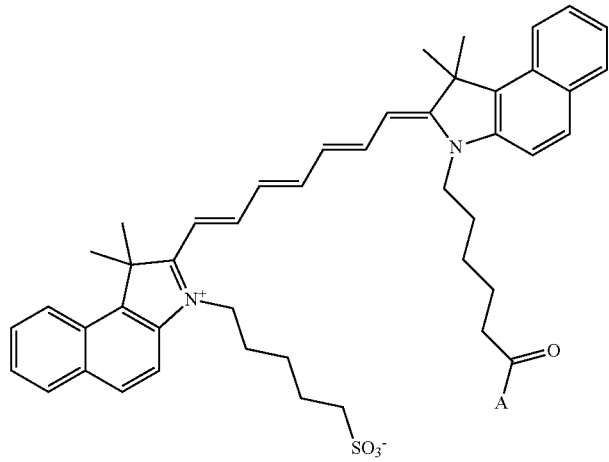
505
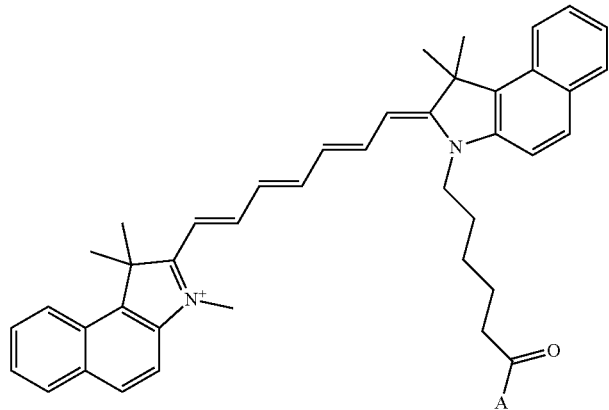
506
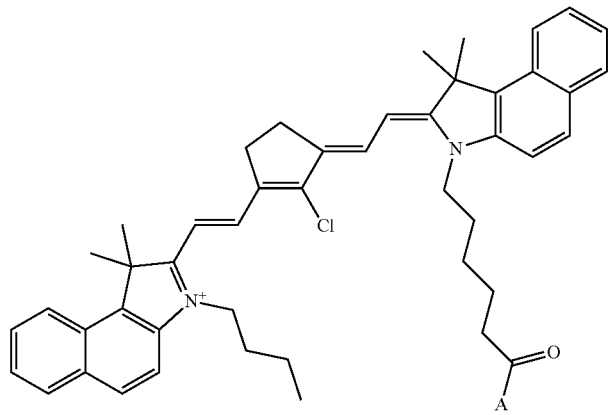

TABLE 10-continued
Exemplary compounds according to the present disclosure.
No. Structure
507
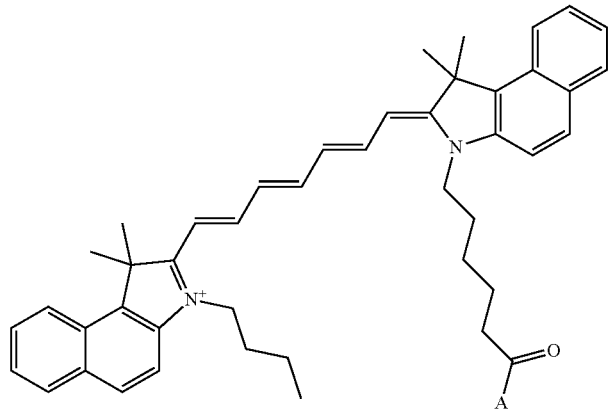
508
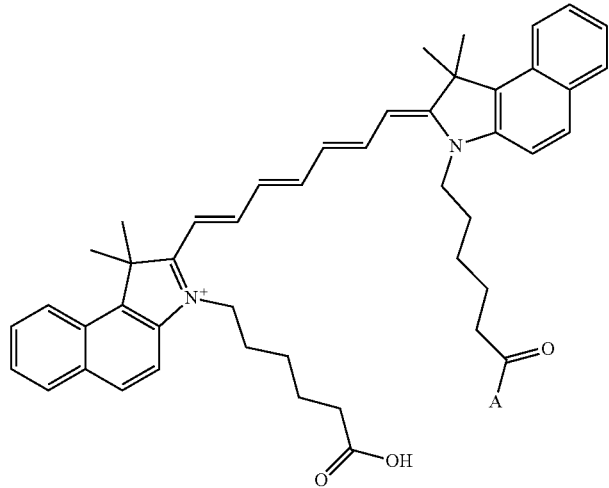
509
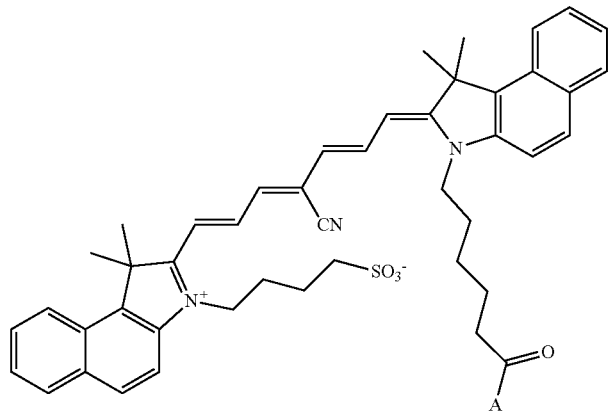

TABLE 10-continued
Exemplary compounds according to the present disclosure.
No. Structure
510
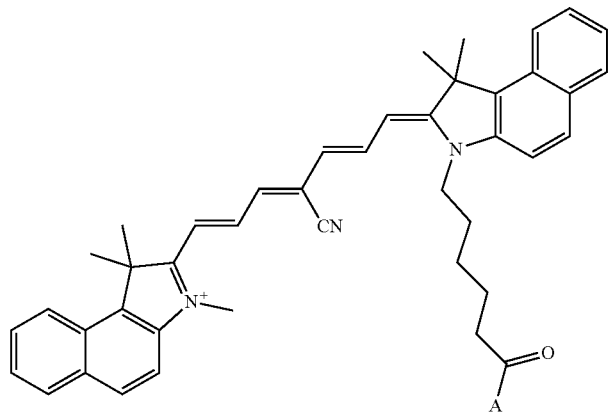
511
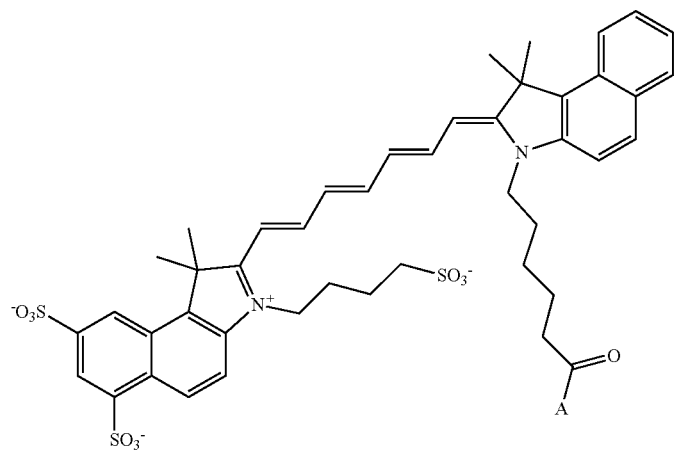
512
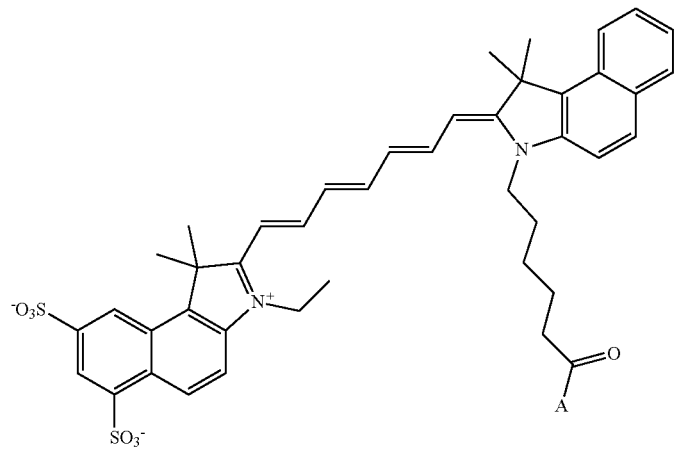

TABLE 10-continued
Exemplary compounds according to the present disclosure.
No. Structure
513
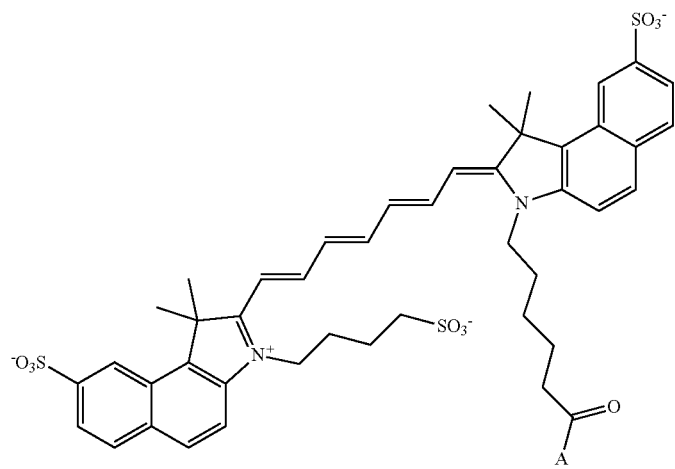
514
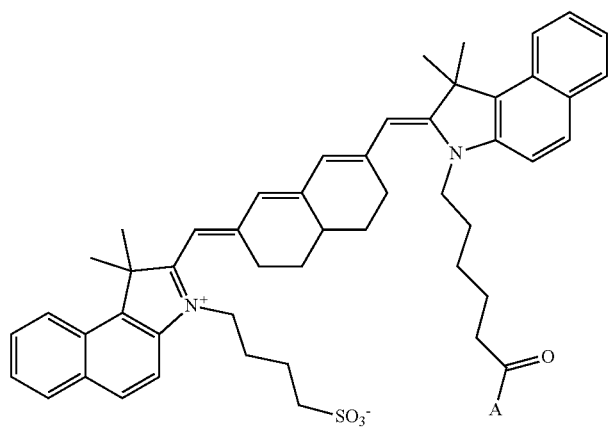
515
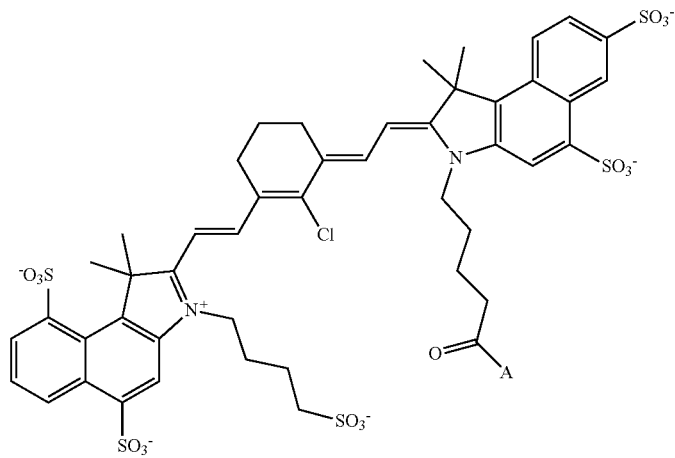

TABLE 10-continued
Exemplary compounds according to the present disclosure.
No. Structure
516
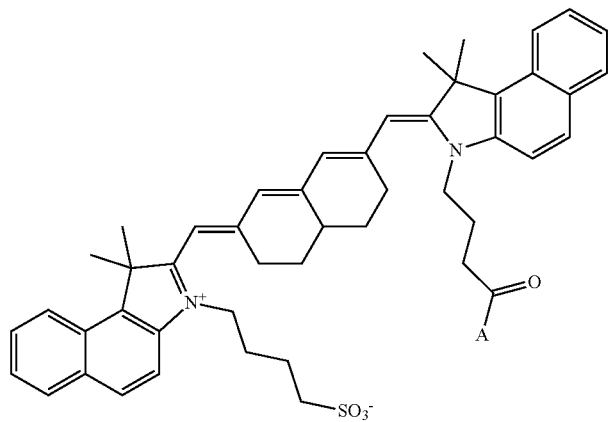
517
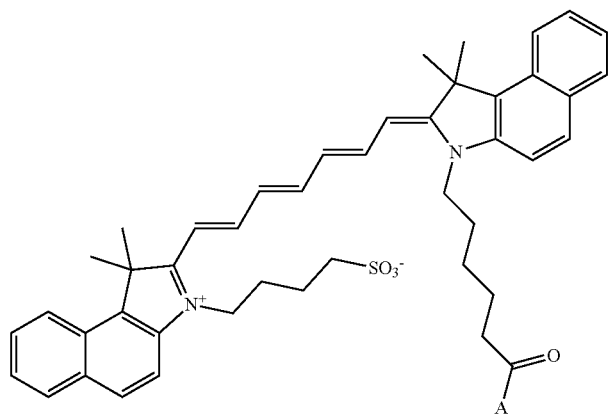
518
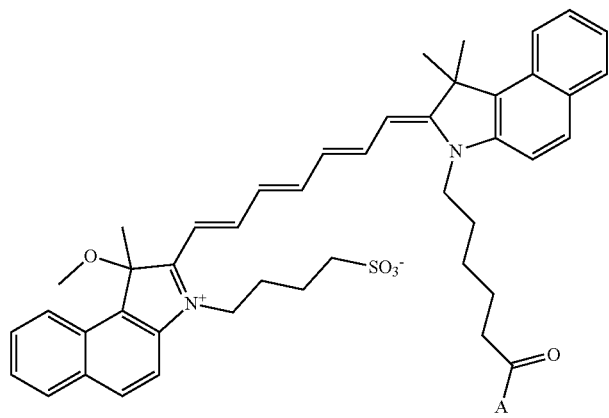

TABLE 10-continued
Exemplary compounds according to the present disclosure.
No. Structure
519
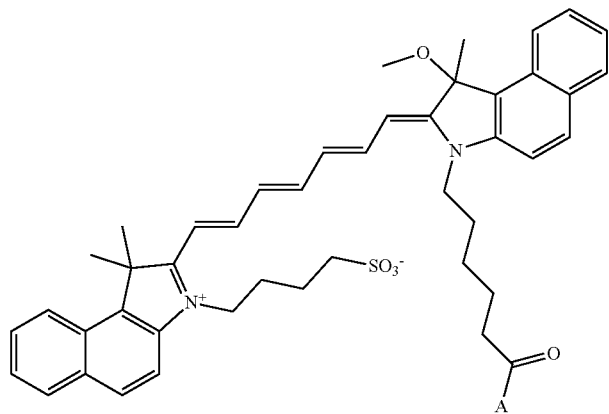
520
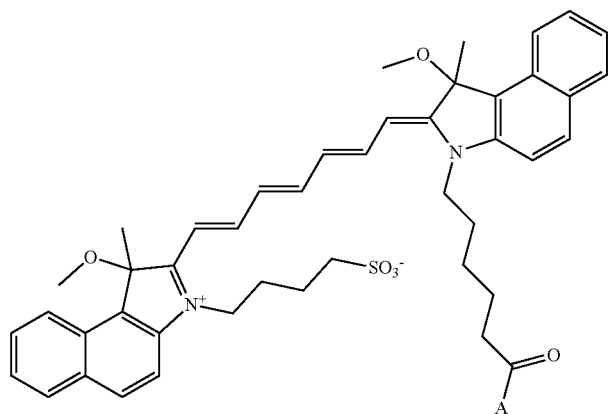
521
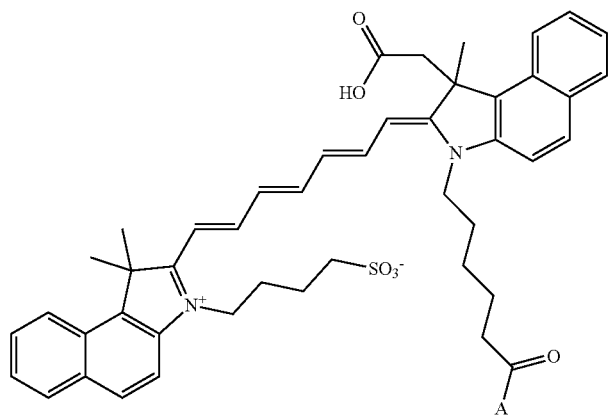

TABLE 10-continued
Exemplary compounds according to the present disclosure.
No. Structure
522
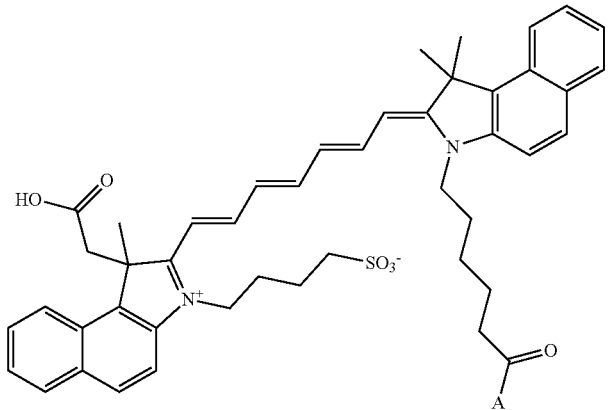
523
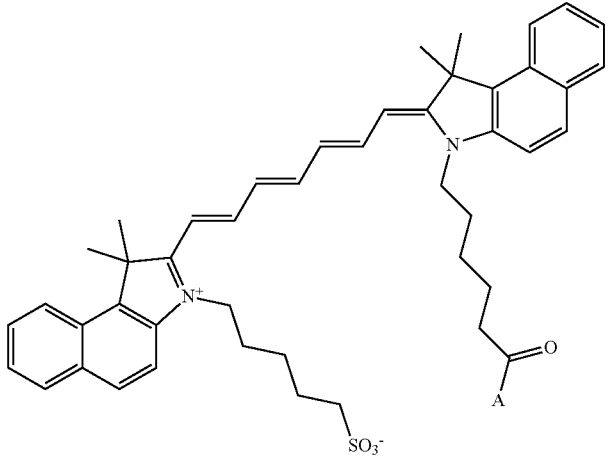
524
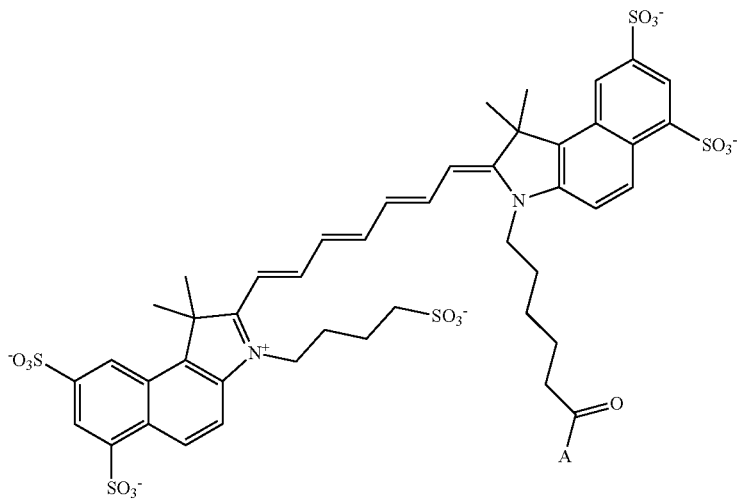

TABLE 10-continued
Exemplary compounds according to the present disclosure.
No. Structure
525
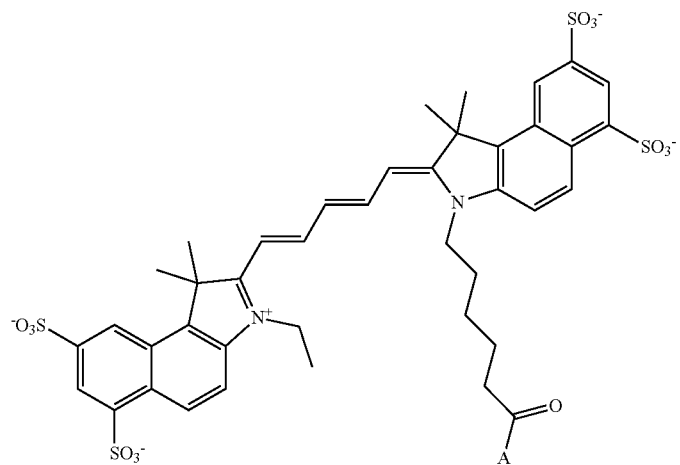
526
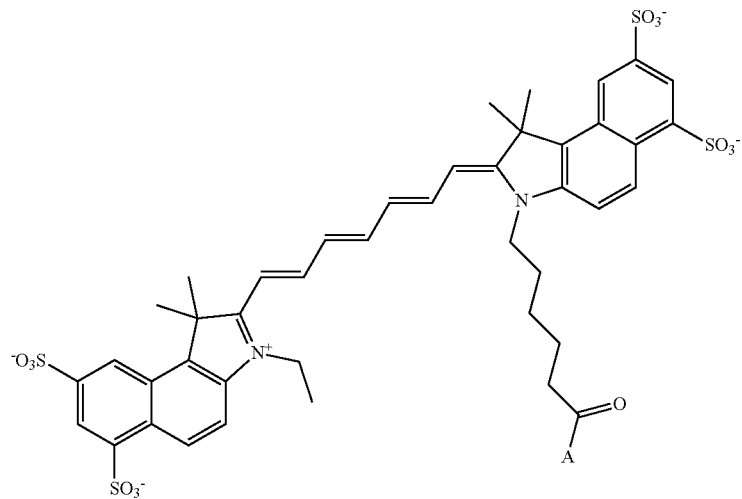
527
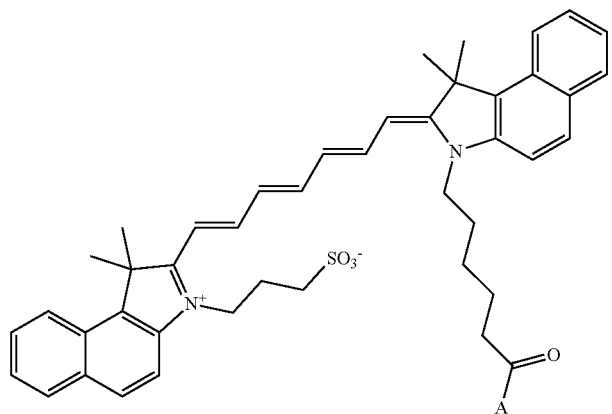

TABLE 10-continued
Exemplary compounds according to the present disclosure.
No. Structure
528
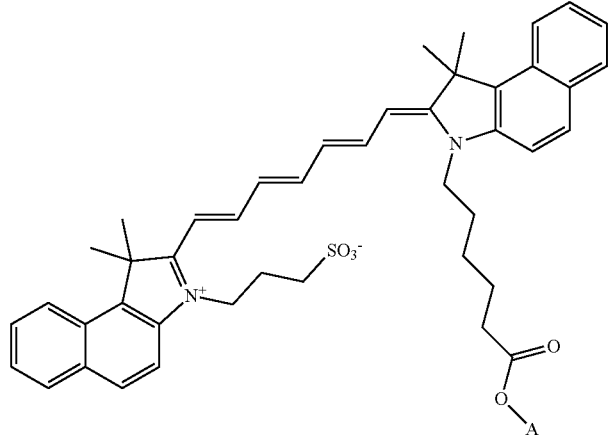
529
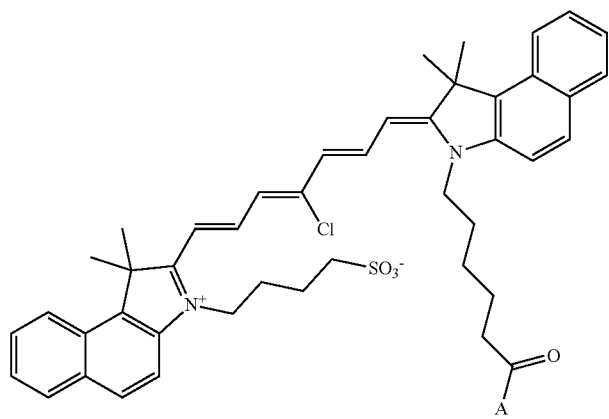
530
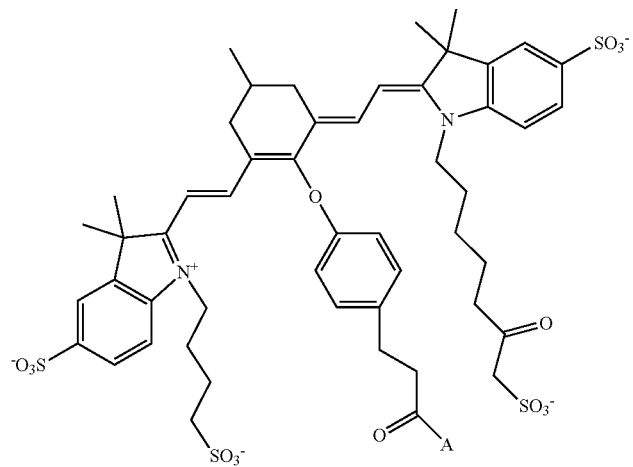
A = MCMPCFTTDHQMARACDDCCGGKGRGRCYGPQCLCR (SEQ ID NO: 20) (attached at K-23)

TABLE 11
Exemplary compounds according to the present disclosure.
No.   Structure
531
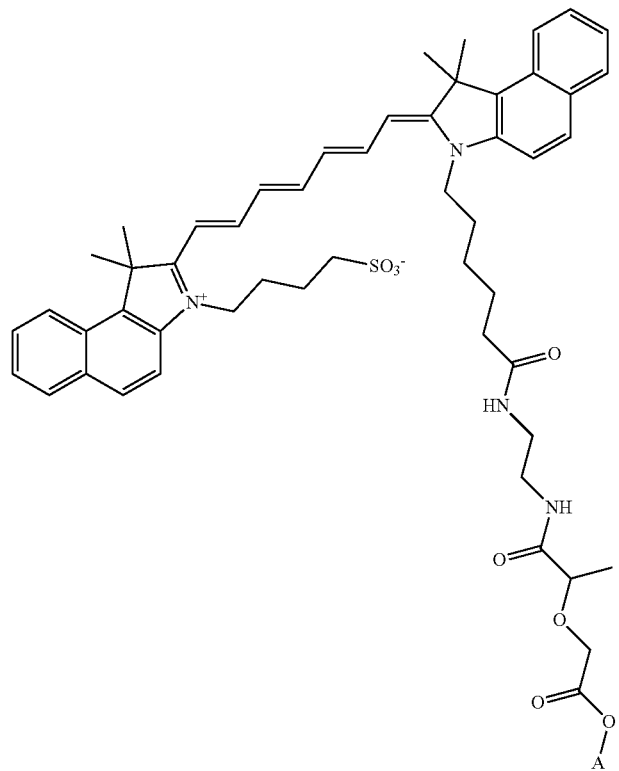
532
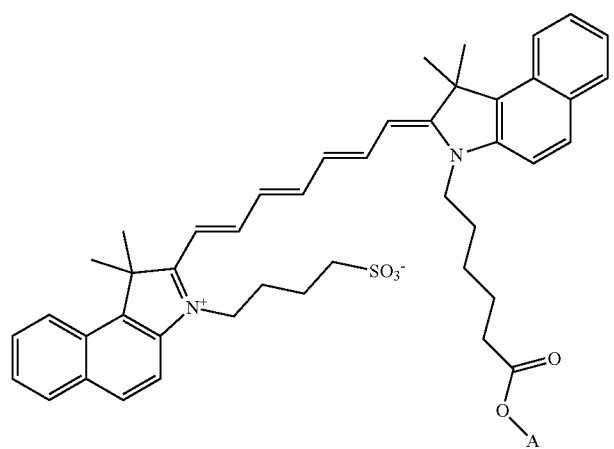

TABLE 11-continued
Exemplary compounds according to the present disclosure.
| No. | Structure |
|---|---|
| 533 | 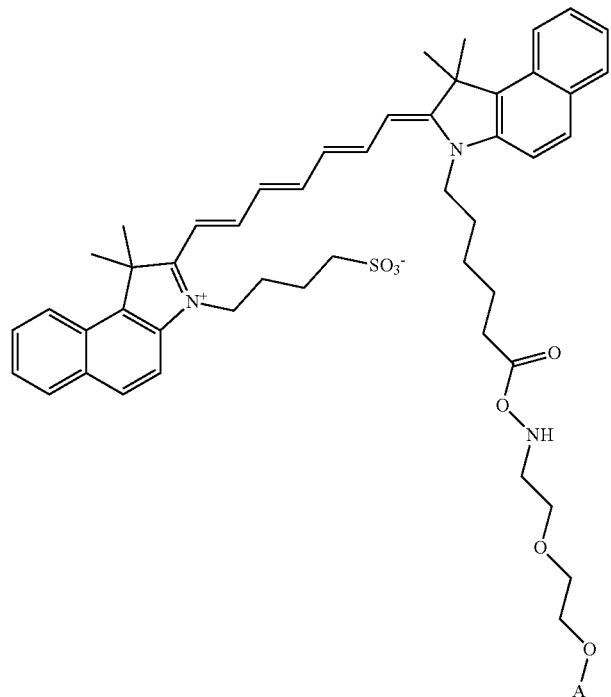 |
| 534 | 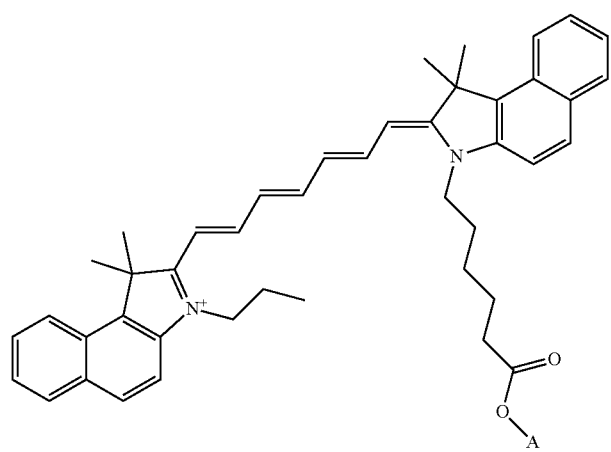 |
| 535 | 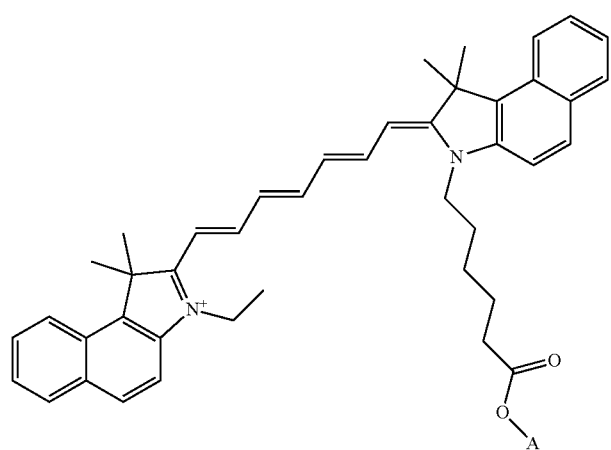 |

TABLE 11-continued
Exemplary compounds according to the present disclosure.
| No. | Structure |
|---|---|
| 536 | 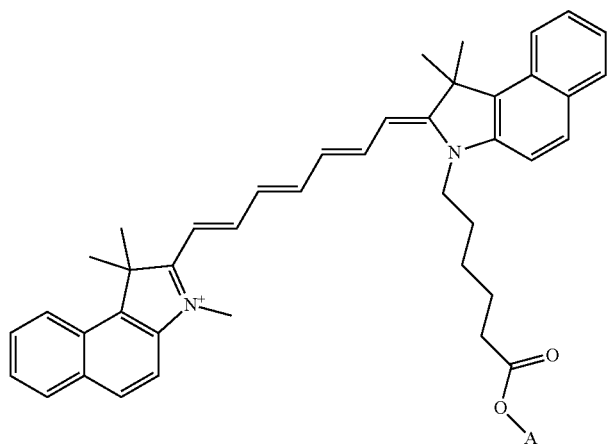 |
| 537 | 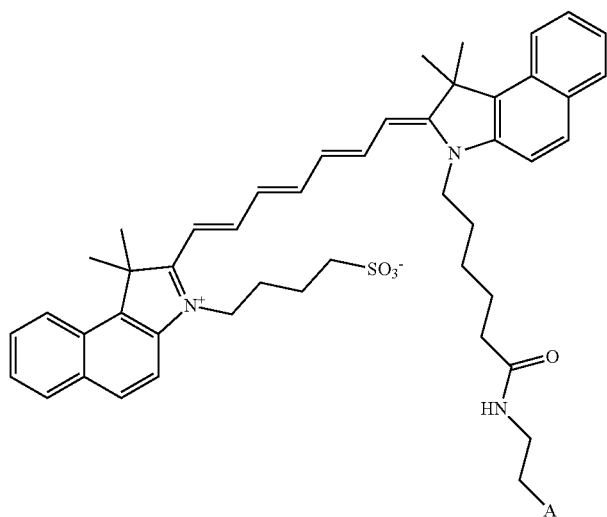 |
| 538 | 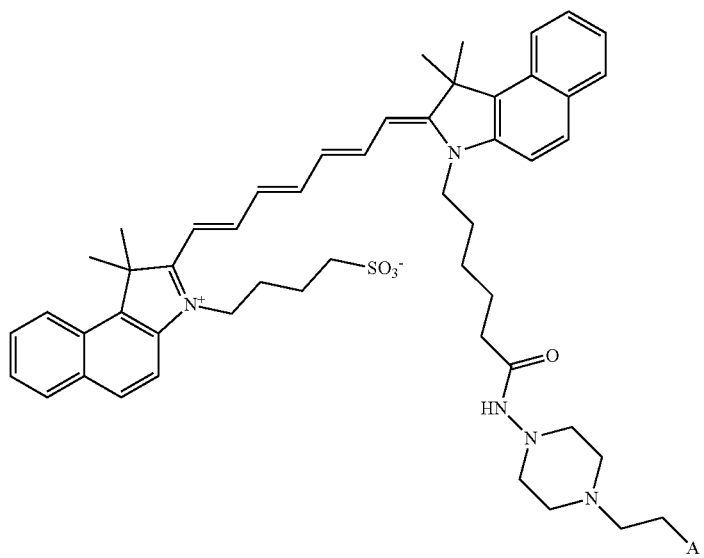 |

TABLE 11-continued
Exemplary compounds according to the present disclosure.
| No. | Structure |
|-----|-----------|
| 539 | 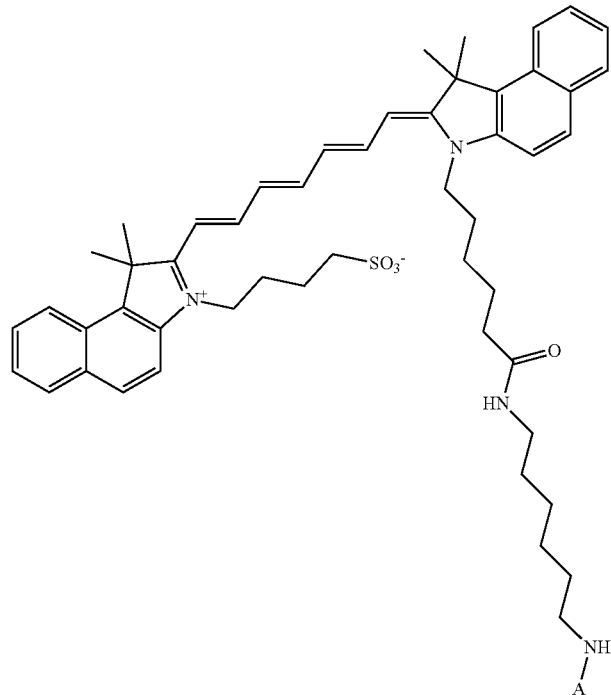 |
| 540 | 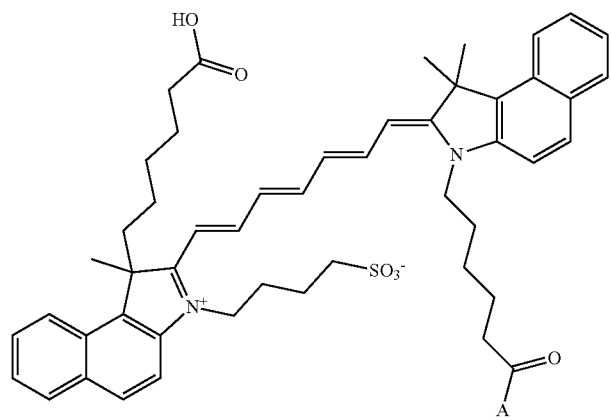 |
| 541 | 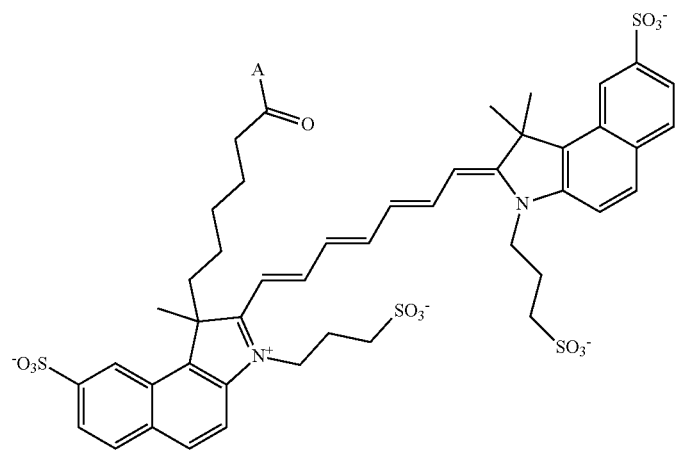 |

TABLE 11-continued
Exemplary compounds according to the present disclosure.
| No. | Structure |
|-----|-----------|
| 542 | 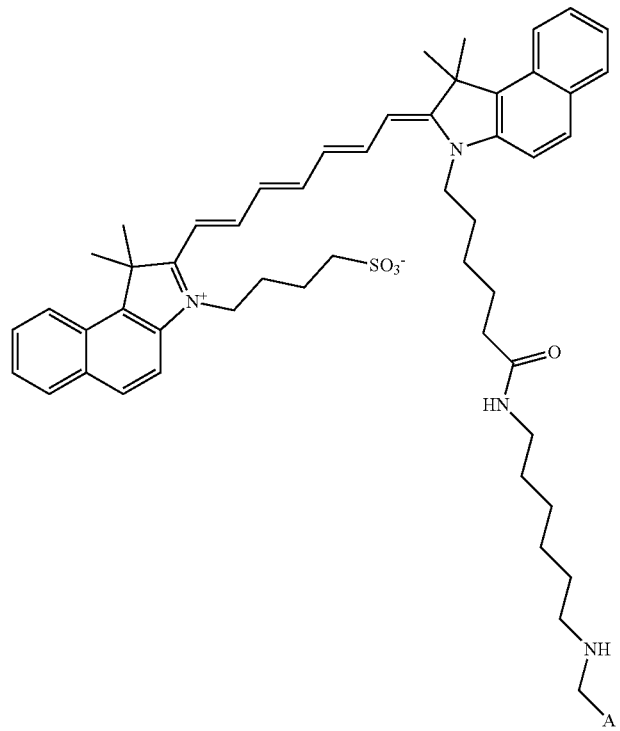 |
| 543 | 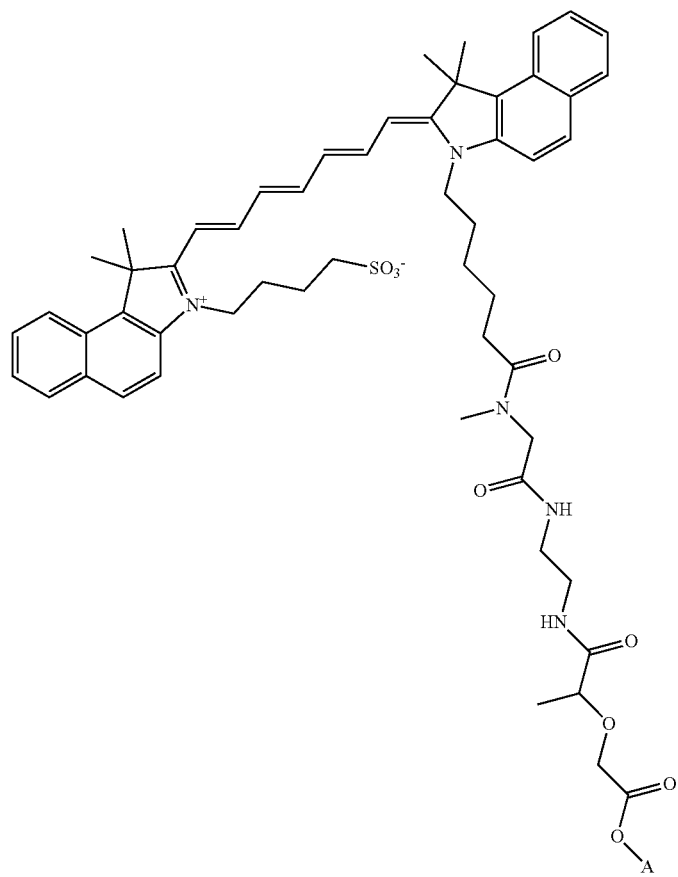 |

TABLE 11-continued
Exemplary compounds according to the present disclosure.
| No. | Structure |
|---|---|
| 544 | 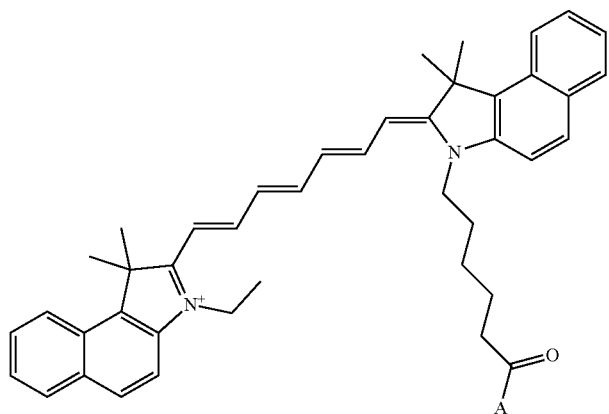 |
| 545 | 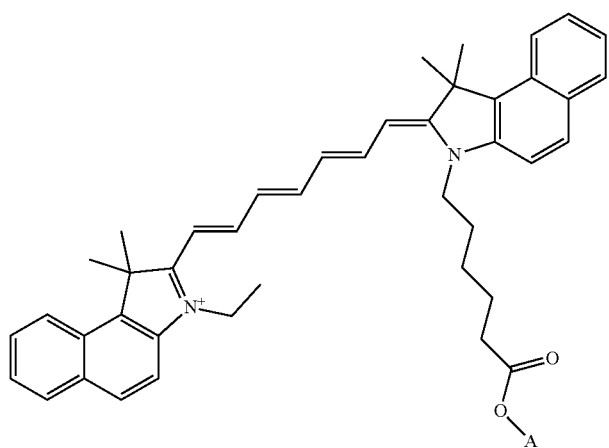 |
| 546 | 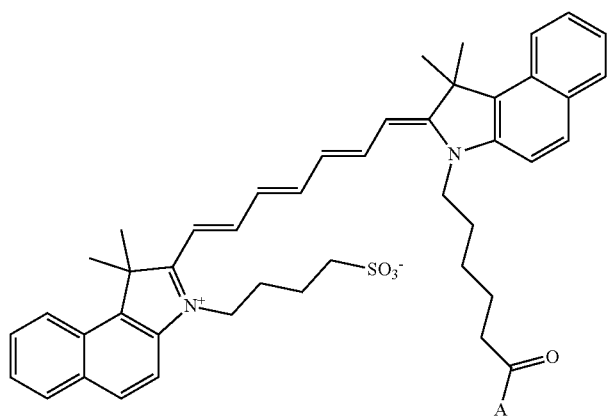 |

TABLE 11-continued
Exemplary compounds according to the present disclosure.
| No. | Structure |
| --- | --- |
547
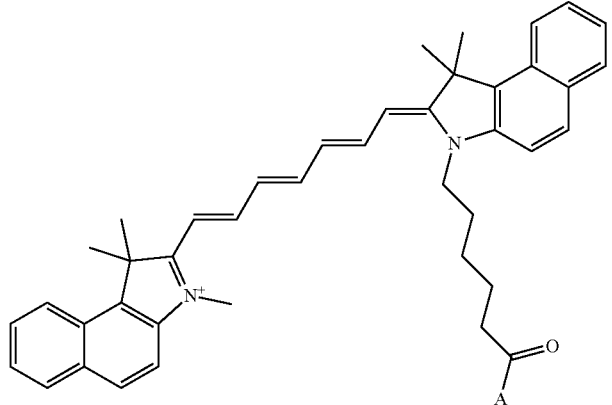
548
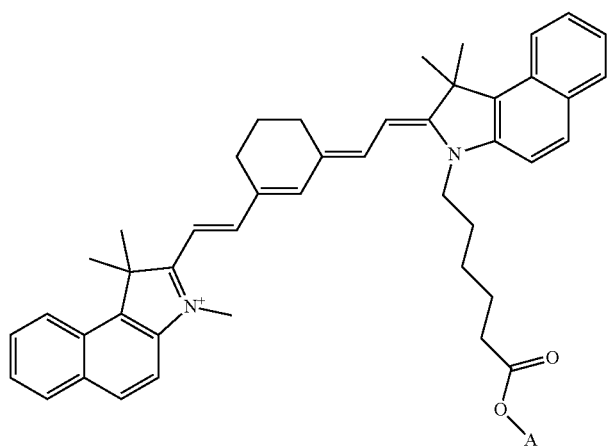
549
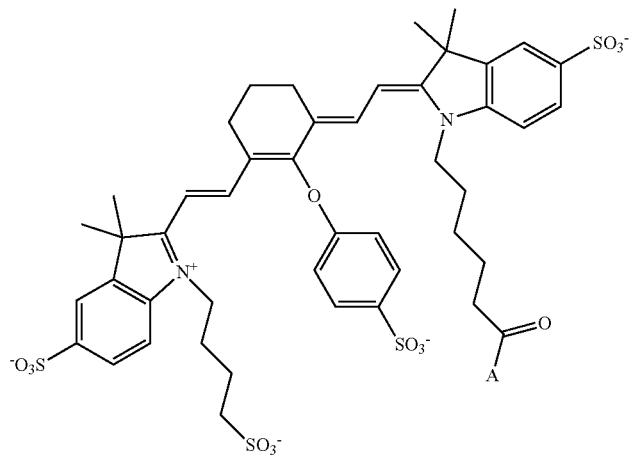

TABLE 11-continued
Exemplary compounds according to the present disclosure.
| No. | Structure |
| --- | --- |
| 550 | 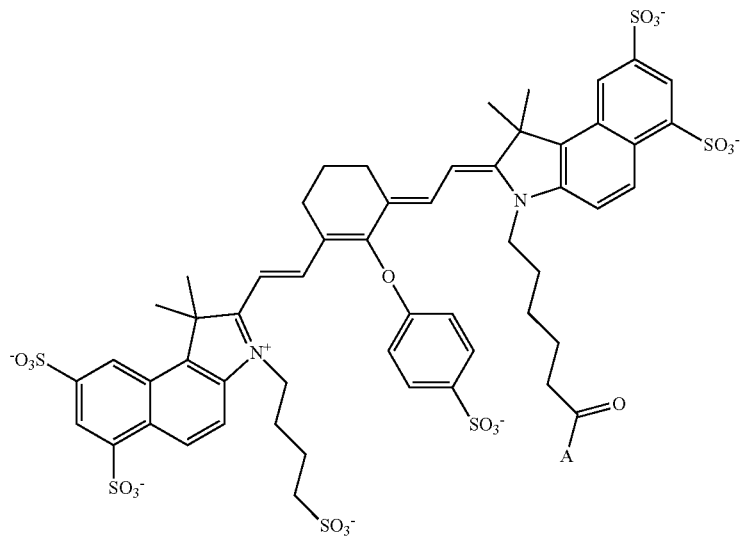 |
| 551 | 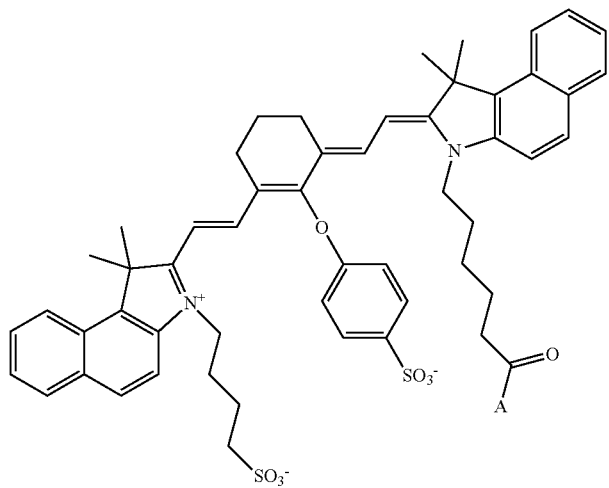 |
| 552 | 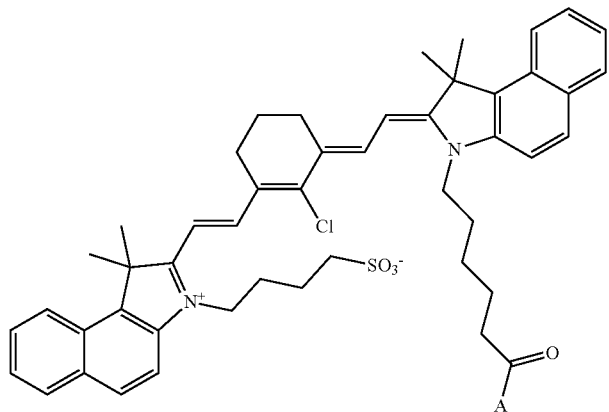 |

TABLE 11-continued
Exemplary compounds according to the present disclosure.
| No. | Structure |
|---|---|
| 553 | 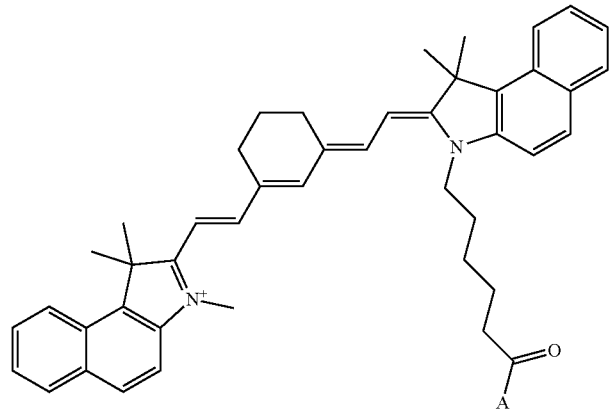 |
| 554 | 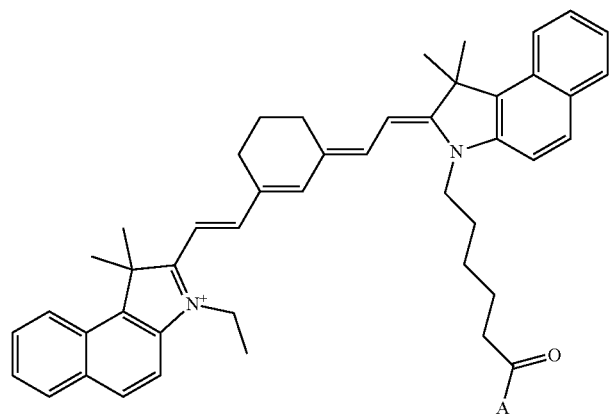 |
| 555 | 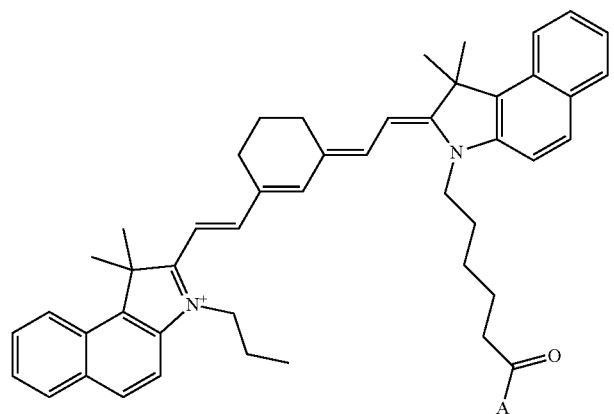 |

TABLE 11-continued
Exemplary compounds according to the present disclosure.
| No. | Structure |
|---|---|
| 556 | 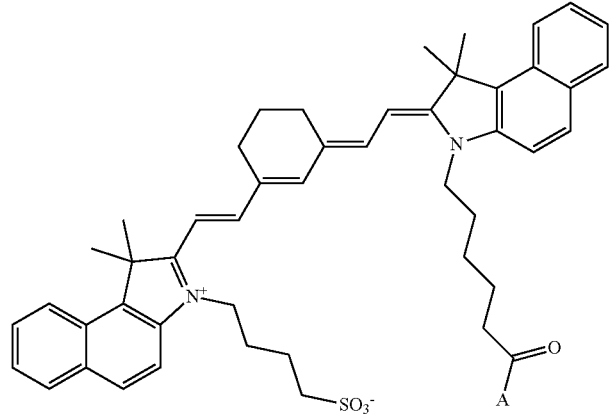 |
| 557 | 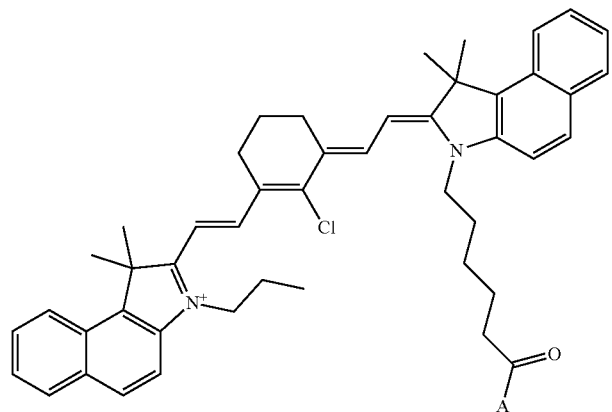 |
| 558 | 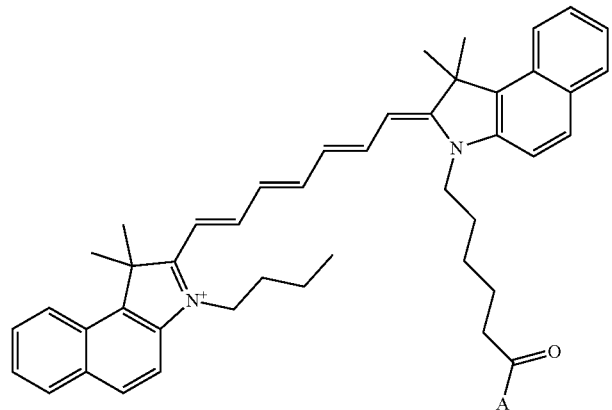 |

TABLE 11-continued
Exemplary compounds according to the present disclosure.
| No. | Structure |
|---|---|
| 559 | 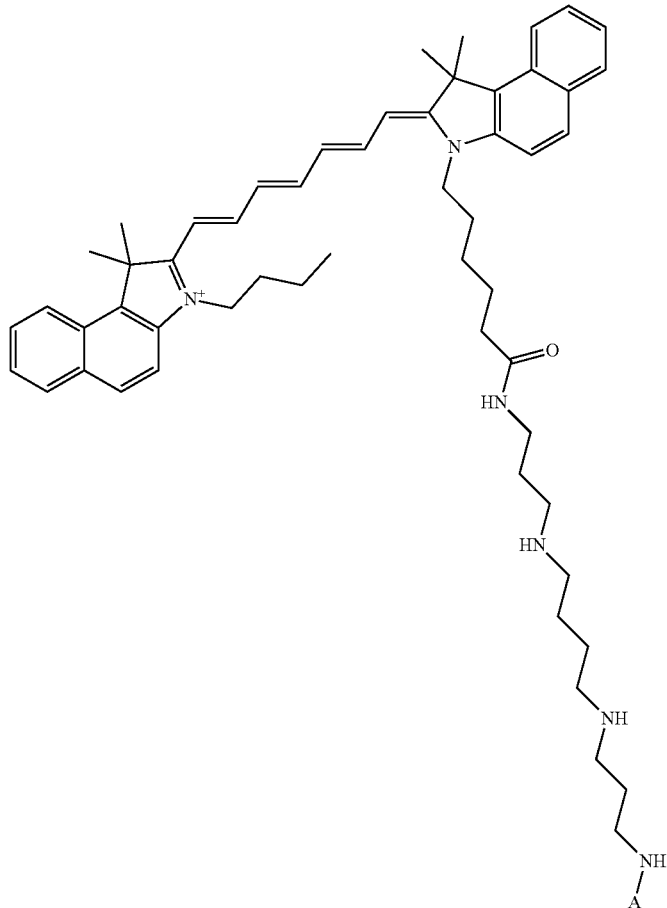 |
| 560 | 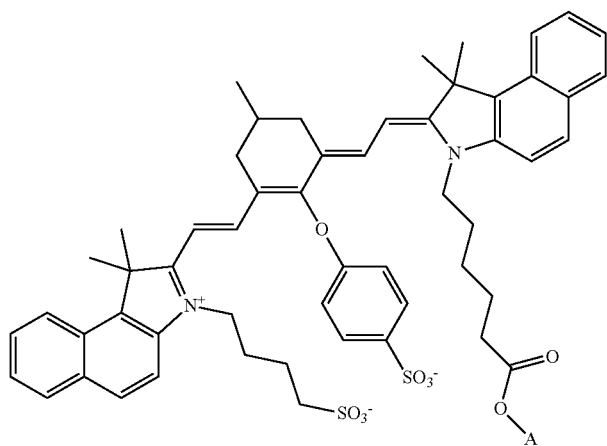 |

TABLE 11-continued
Exemplary compounds according to the present disclosure.
| No. | Structure |
|---|---|
| 561 | 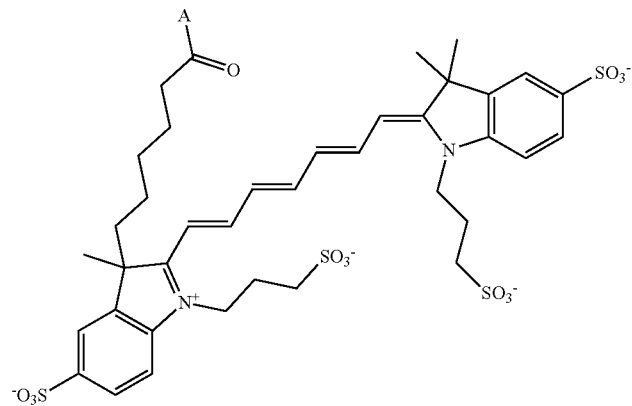 |
| 562 | 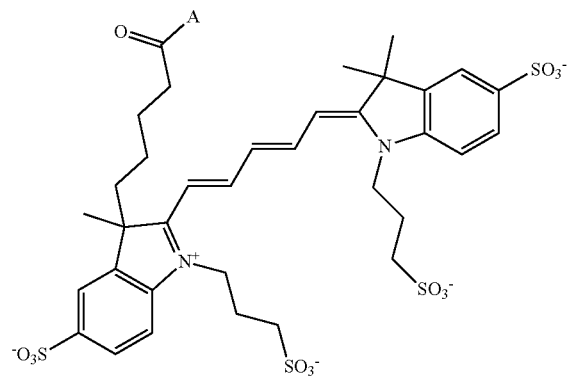 |
| 563 | 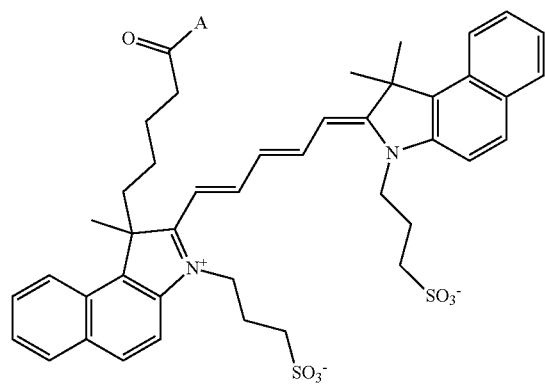 |

TABLE 11-continued
Exemplary compounds according to the present disclosure.
| No. | Structure |
|---|---|
| 564 | 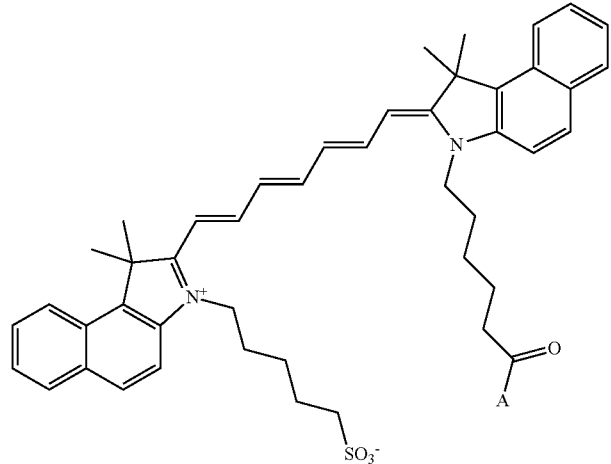 |
| 565 | 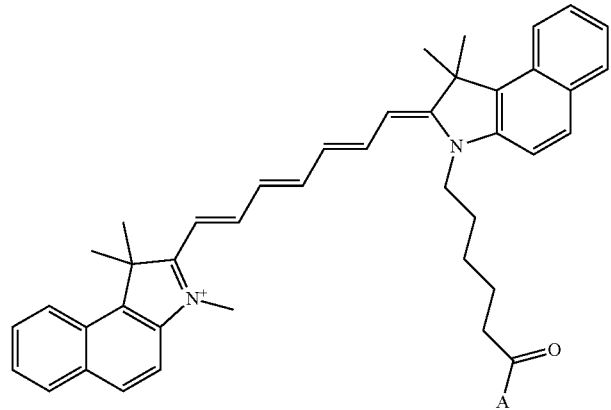 |
| 566 | 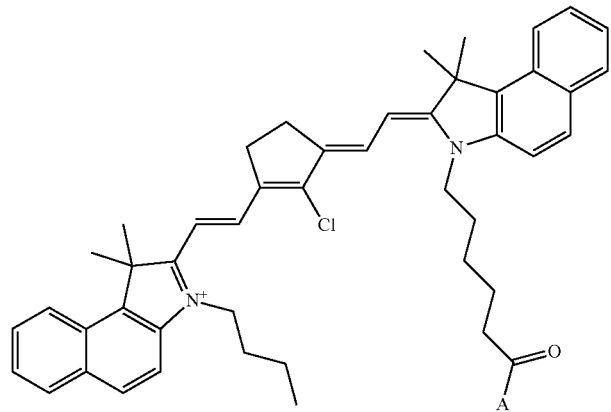 |

TABLE 11-continued
Exemplary compounds according to the present disclosure.
| No. | Structure |
|---|---|
| 567 | 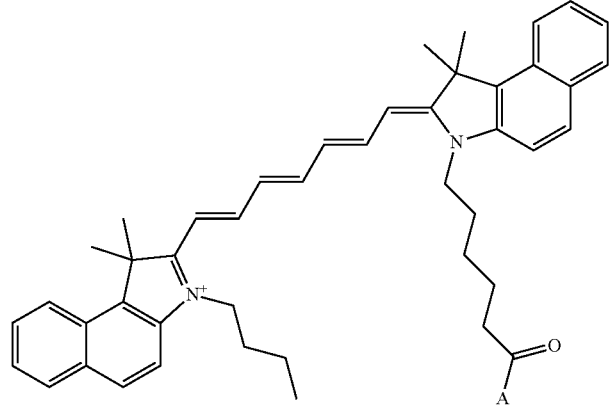 |
| 568 | 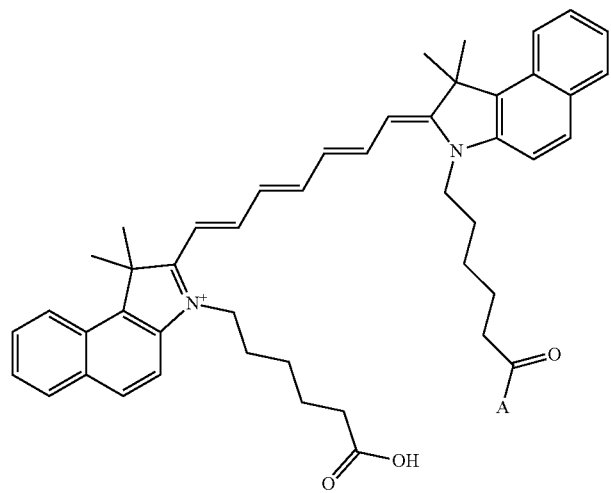 |
| 569 | 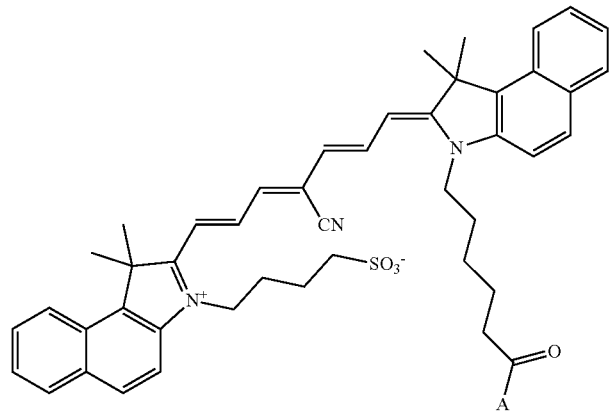 |

TABLE 11-continued
Exemplary compounds according to the present disclosure.
| No. | Structure |
|---|---|
| 570 | 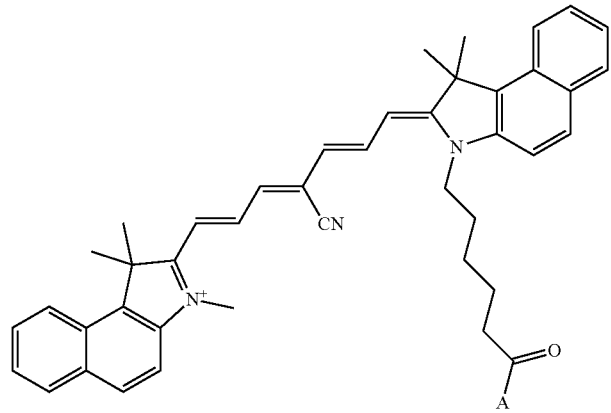 |
| 571 | 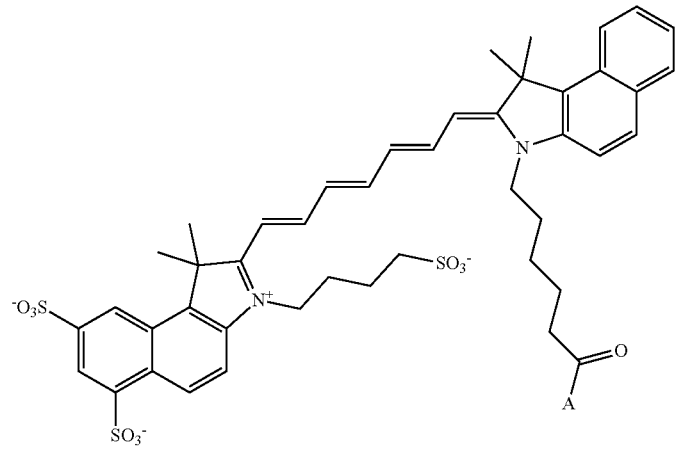 |
| 572 | 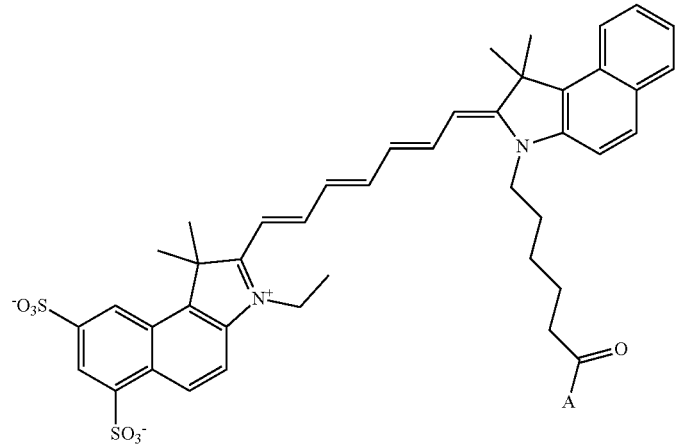 |

TABLE 11-continued
Exemplary compounds according to the present disclosure.
| No. | Structure |
| --- | --- |
| 573 | 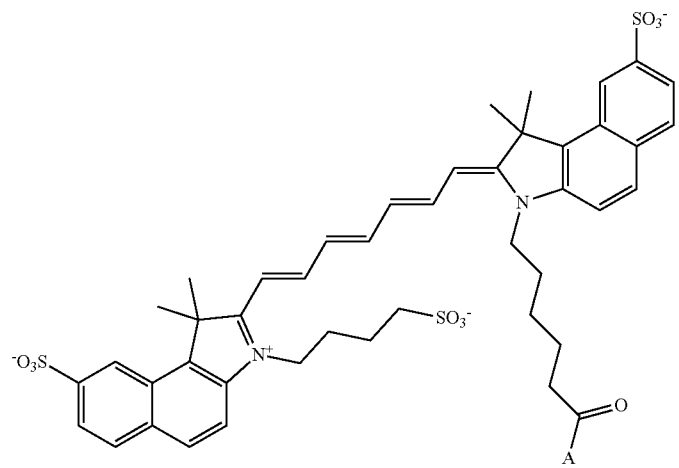 |
| 574 | 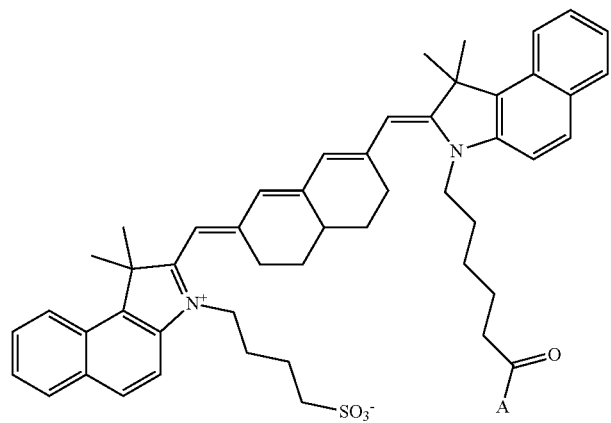 |
| 575 | 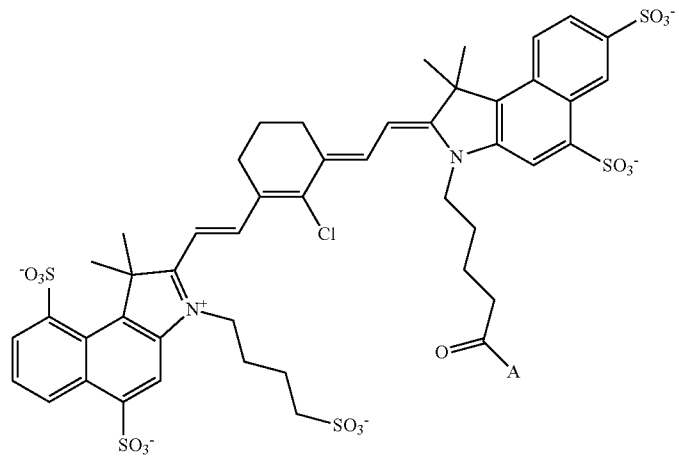 |

TABLE 11-continued
Exemplary compounds according to the present disclosure.
| No. | Structure |
| --- | --- |
| 576 | 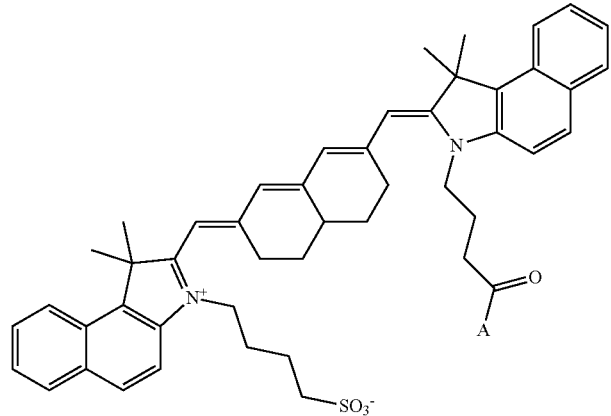 |
| 577 | 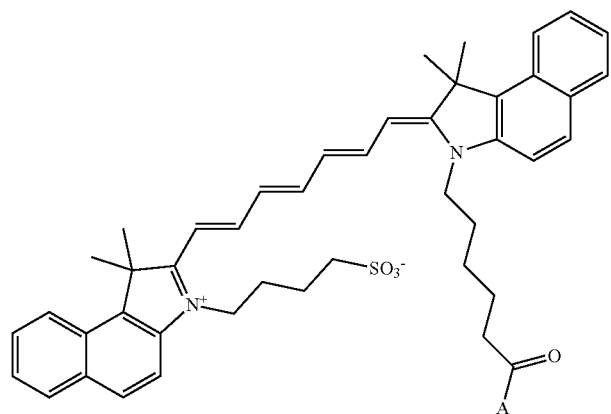 |
| 578 | 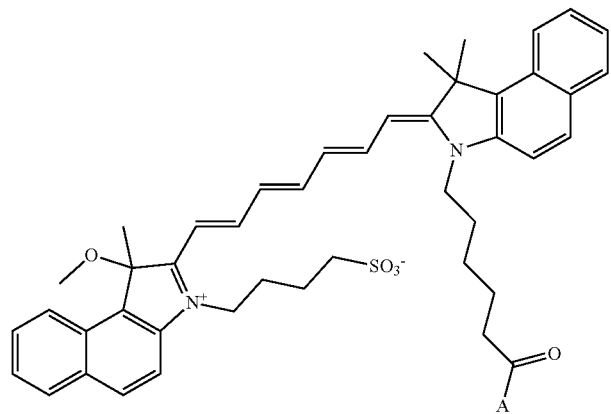 |

TABLE 11-continued
Exemplary compounds according to the present disclosure.
| No. | Structure |
|-----|-----------|
| 579 | 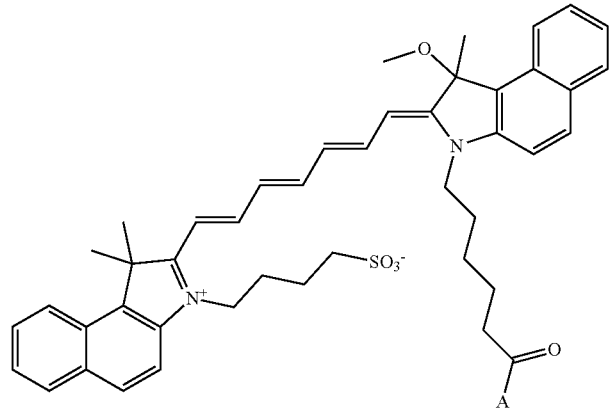 |
| 580 | 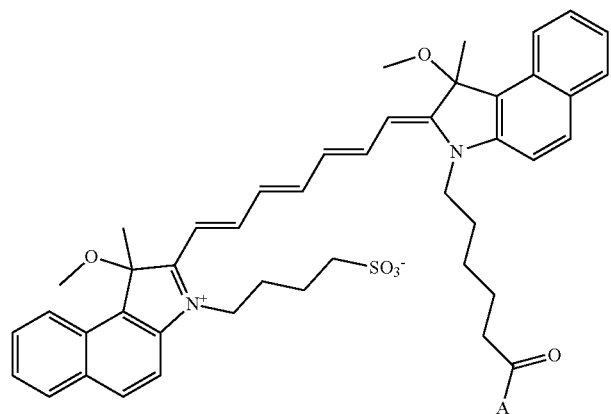 |
| 581 | 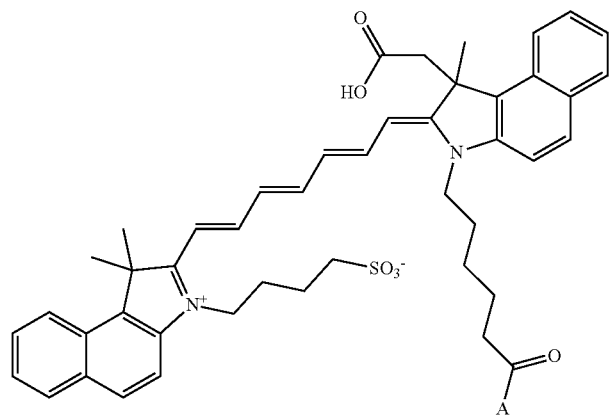 |

TABLE 11-continued
Exemplary compounds according to the present disclosure.
| No. | Structure |
|---|---|
| 582 | 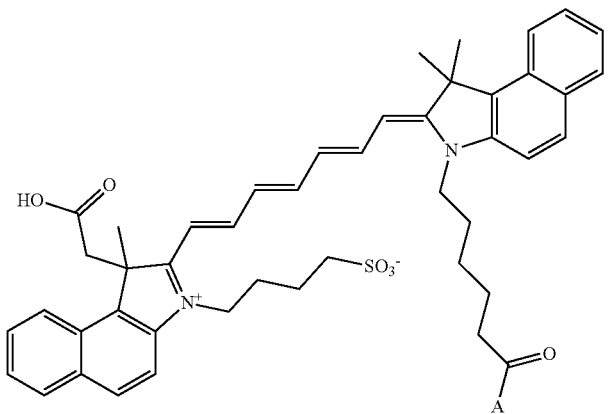 |
| 583 | 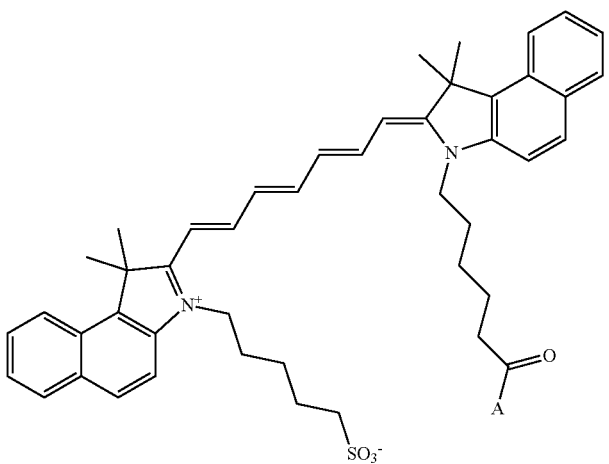 |
| 584 | 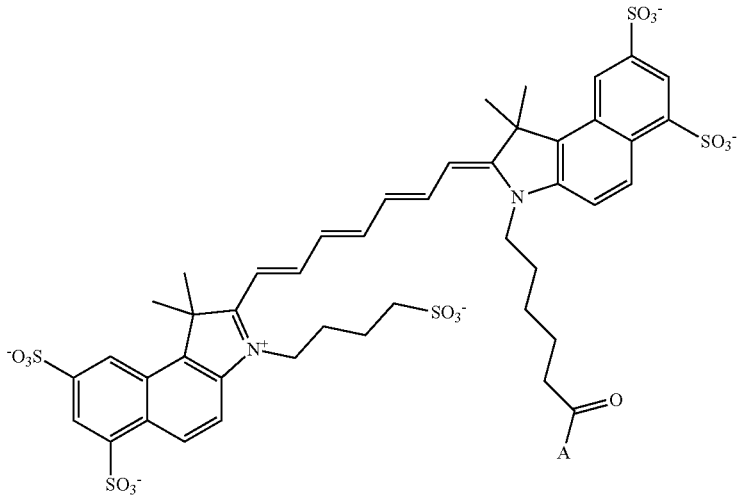 |

TABLE 11-continued
Exemplary compounds according to the present disclosure.
| No. | Structure |
|---|---|
| 585 | 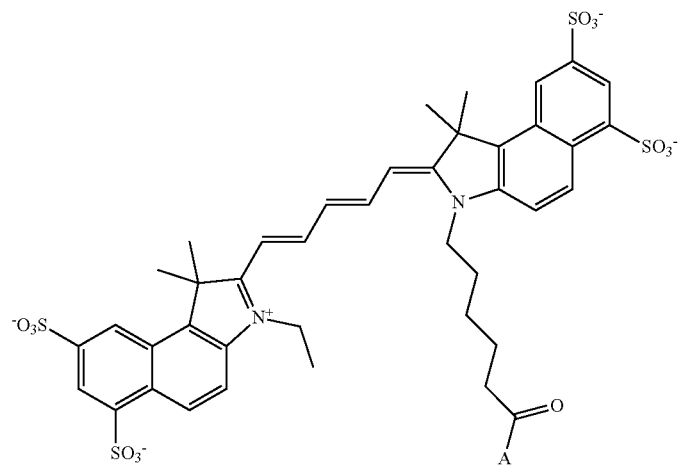 |
| 586 | 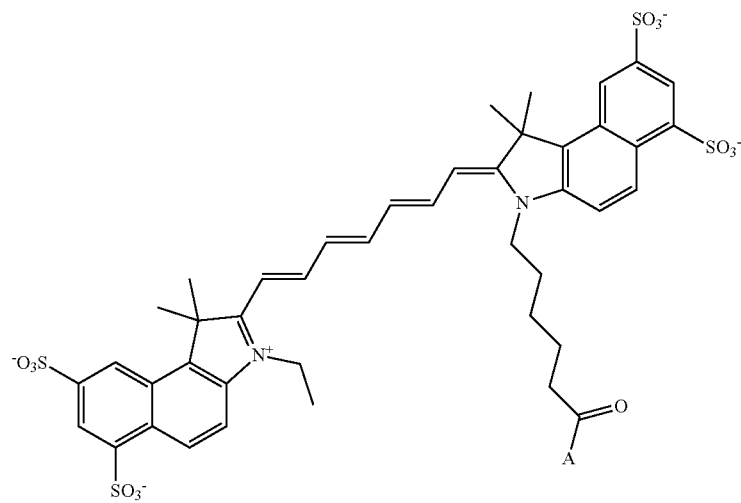 |
| 587 | 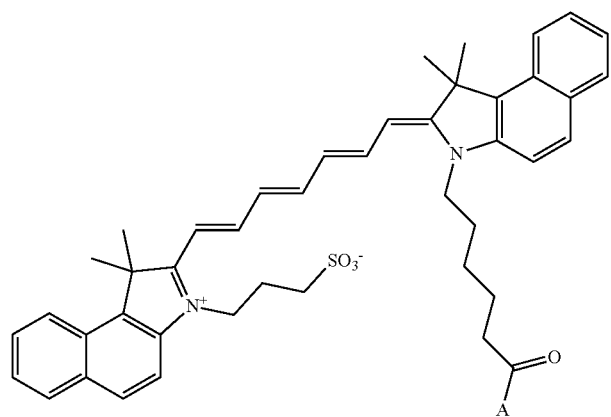 |

TABLE 11-continued
Exemplary compounds according to the present disclosure.
No. Structure
588
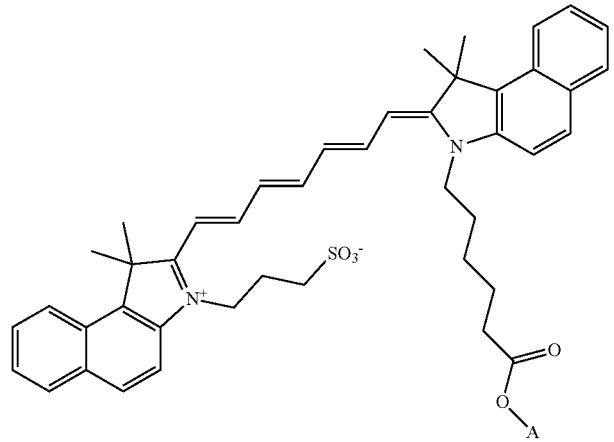
589
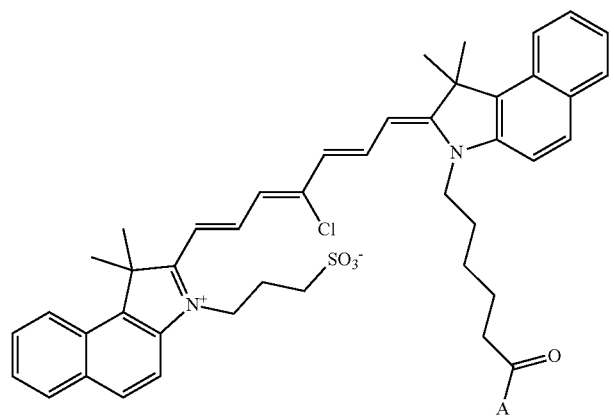
590
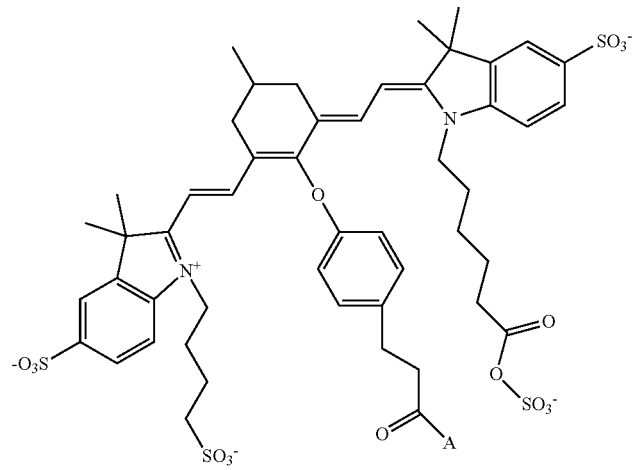
A = MCMPCFTTDHQMARRCDDCCGGKGRGRCYGPQC (SEQ ID NO: 21) (attached at K-23)

TABLE 12
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 591 | 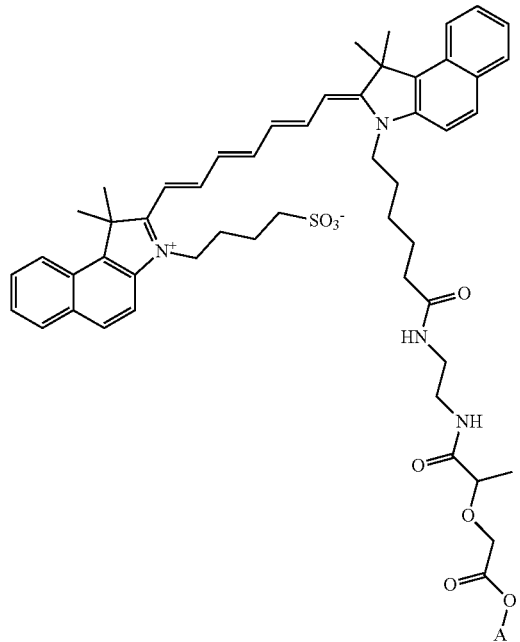 |
| 592 | 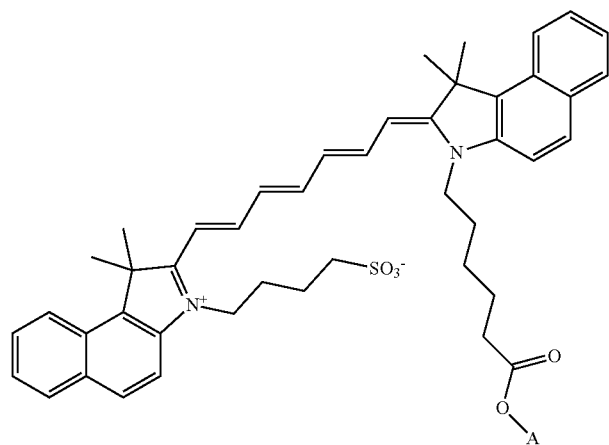 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 593 | 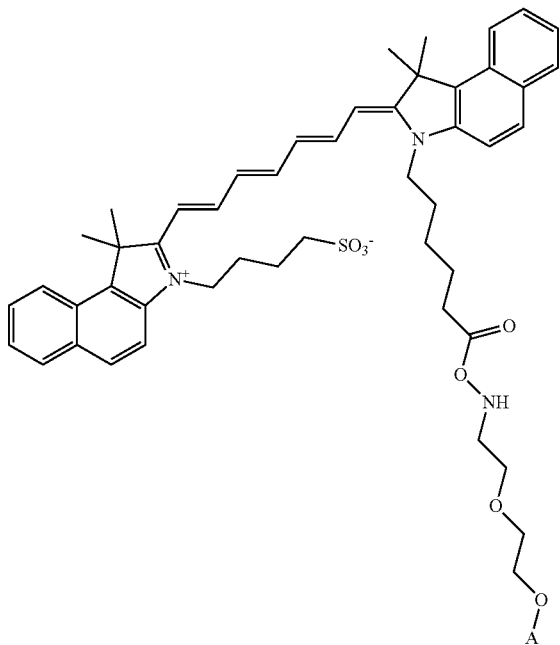 |
| 594 | 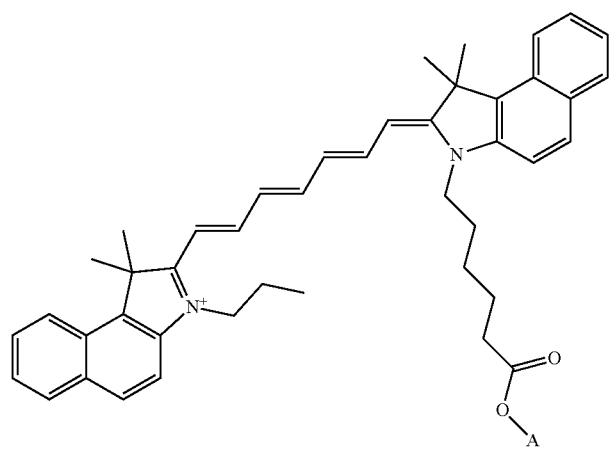 |
| 595 | 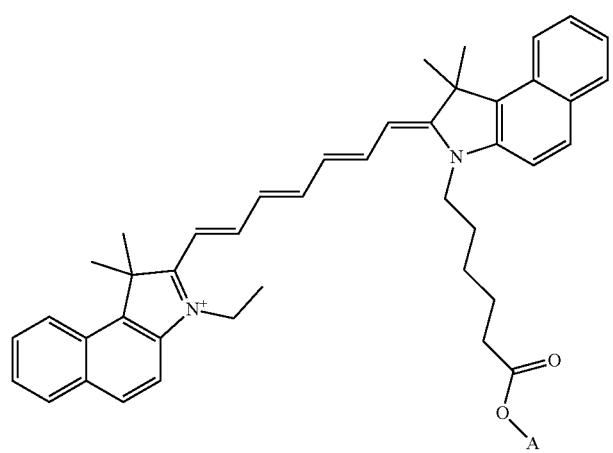 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 596 | 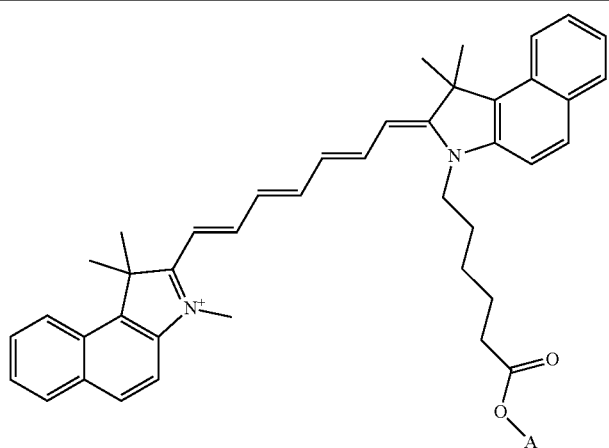 |
| 597 | 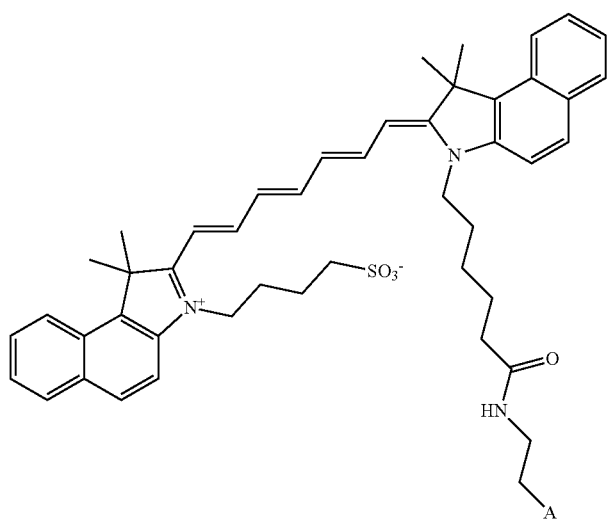 |
| 598 | 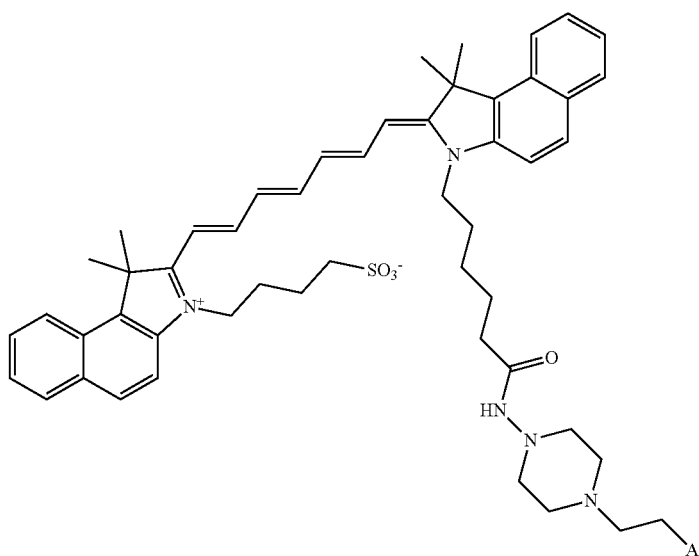 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 599 | 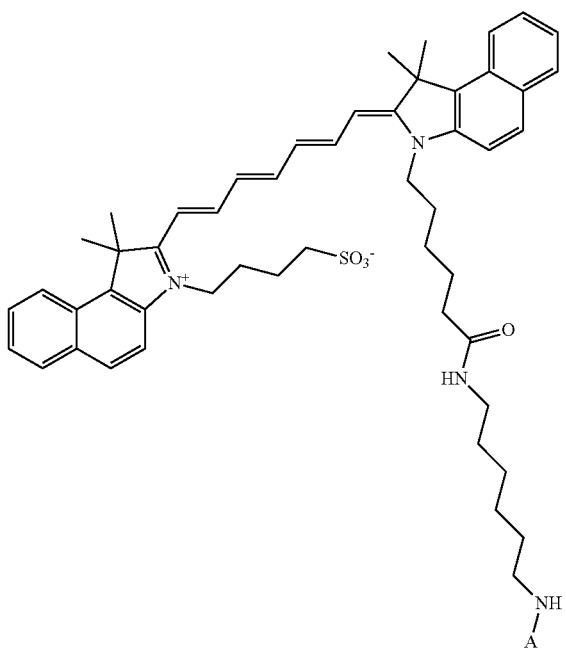 |
| 600 | 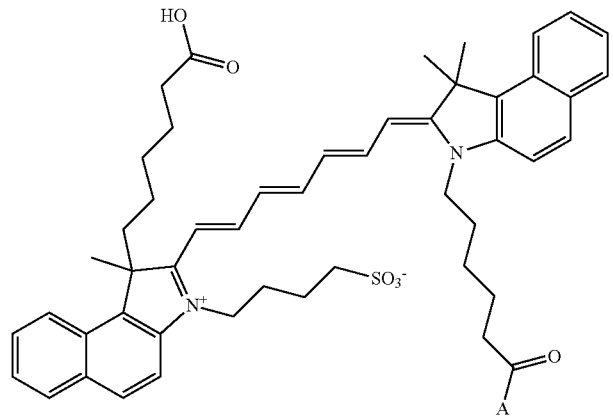 |
| 601 | 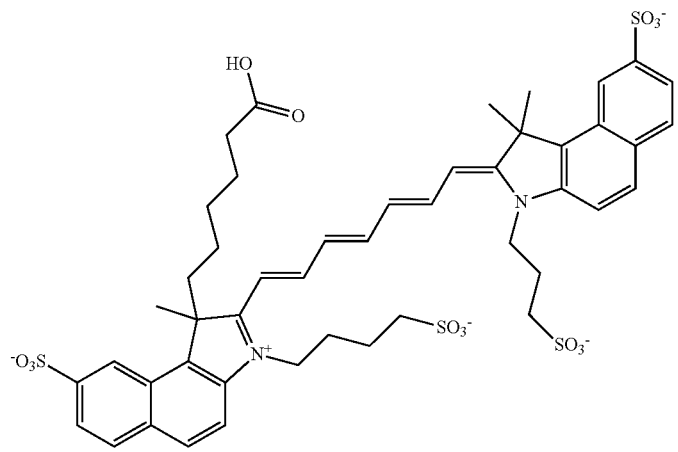 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 602 | 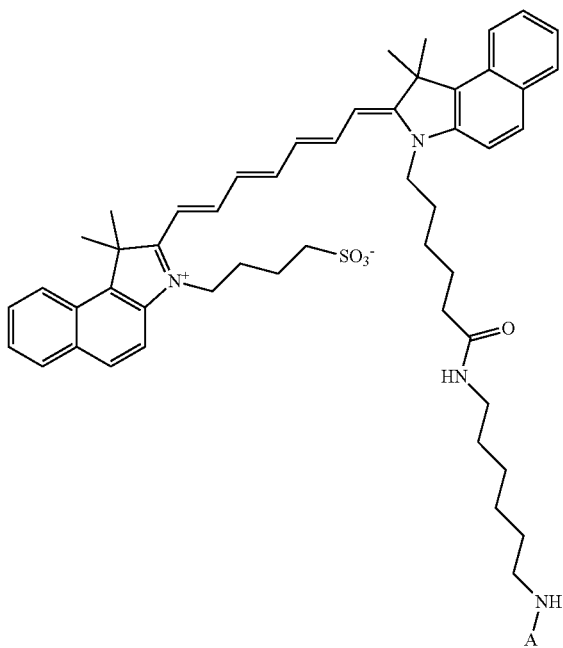 |
| 603 | 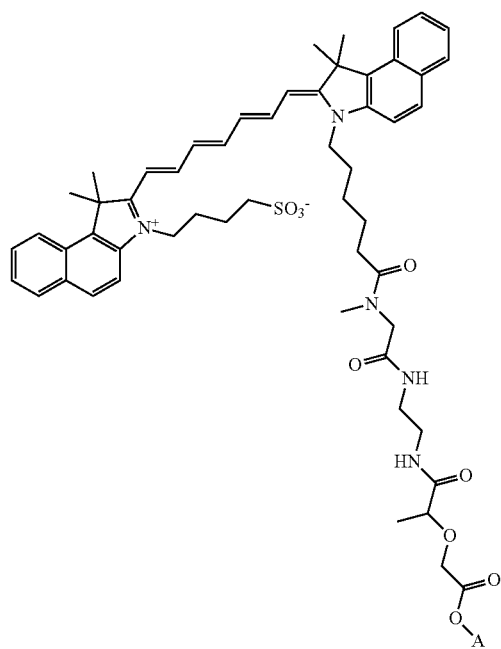 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 604 | 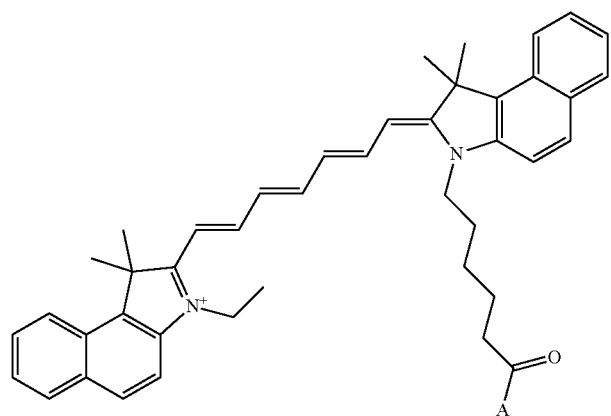 |
| 605 | 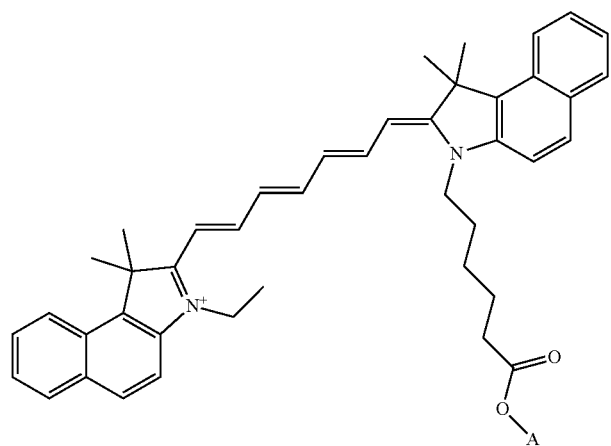 |
| 606 | 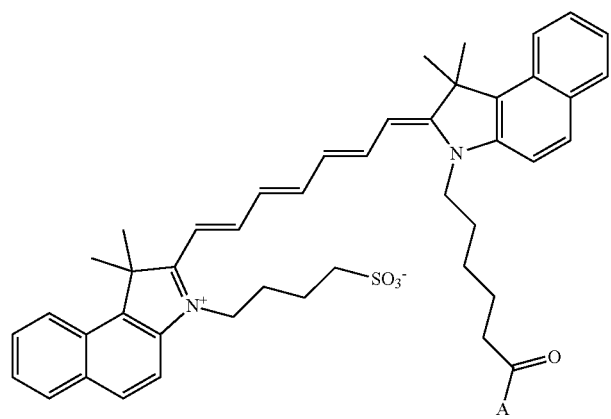 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 607 | 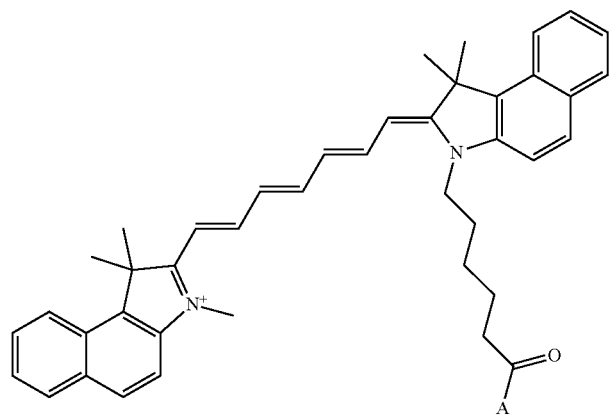 |
| 608 | 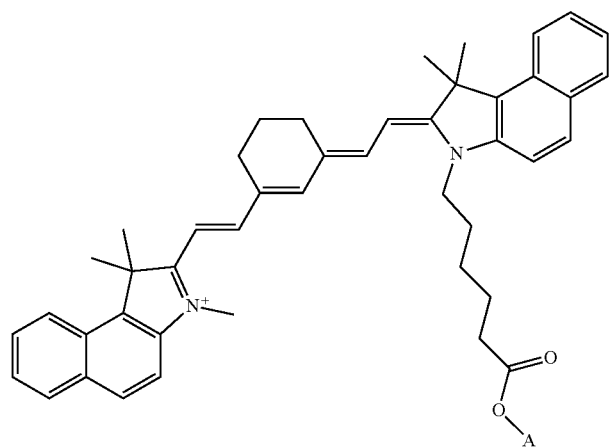 |
| 609 | 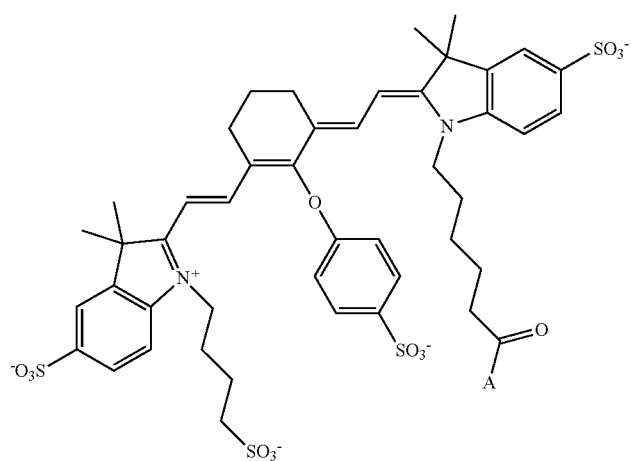 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|-----|-----------|
| 610 | 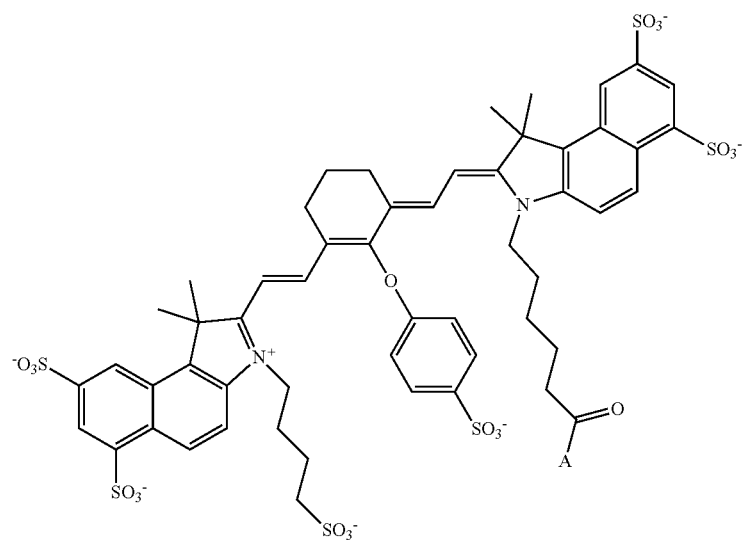 |
| 611 | 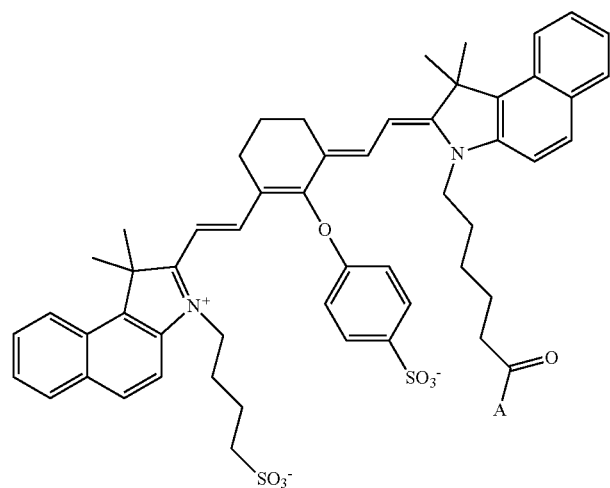 |
| 612 | 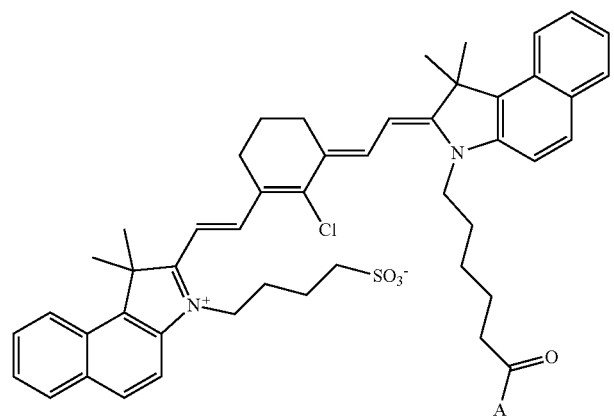 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
| --- | --- |
| 613 | 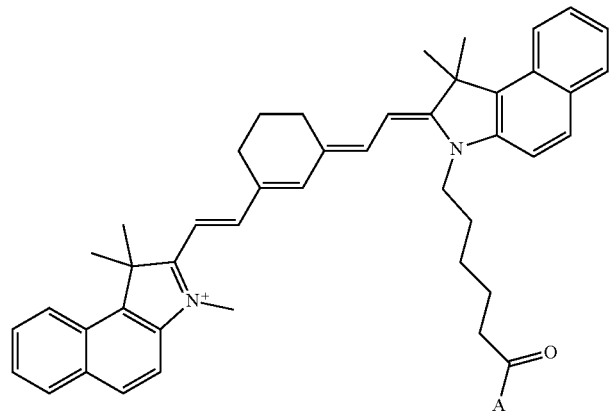 |
| 614 | 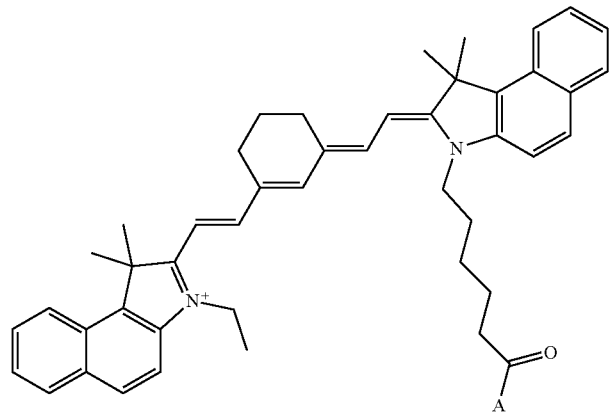 |
| 615 | 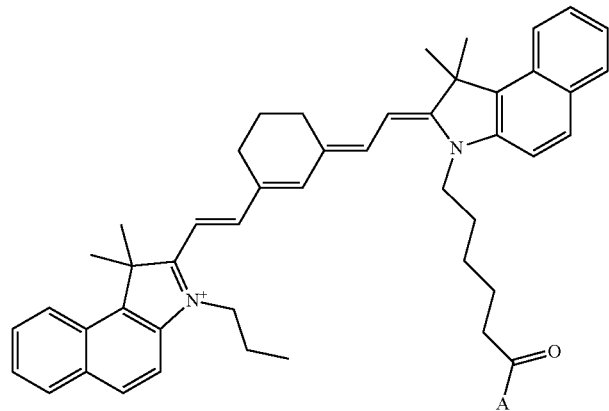 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 616 | 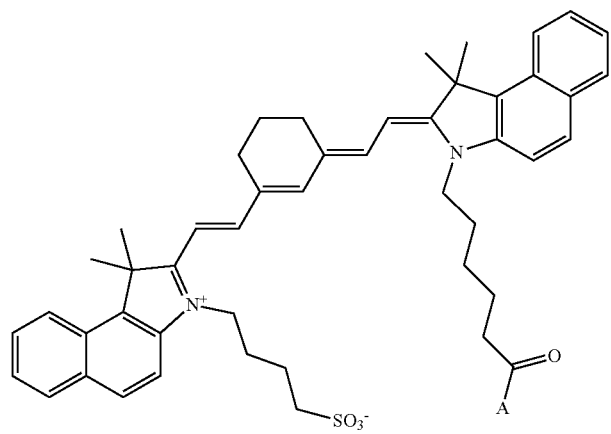 |
| 617 | 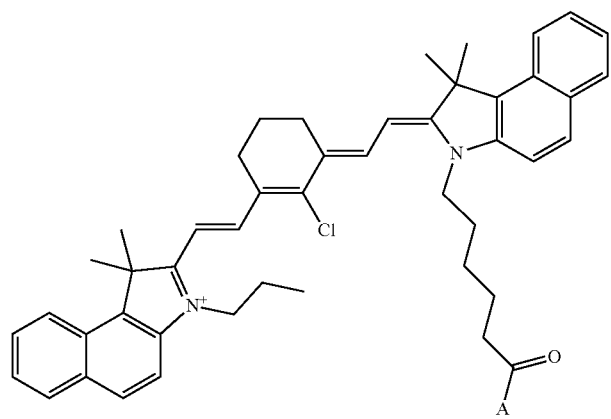 |
| 618 | 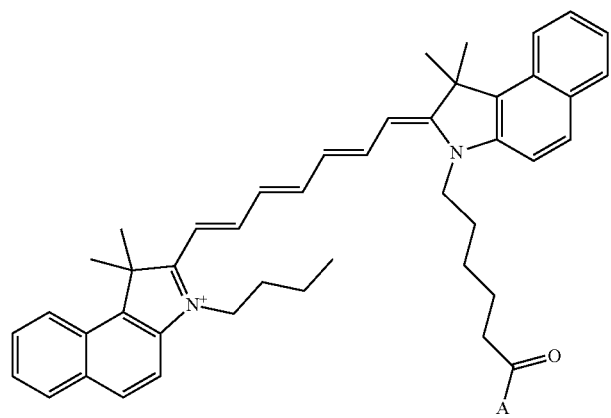 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 619 | 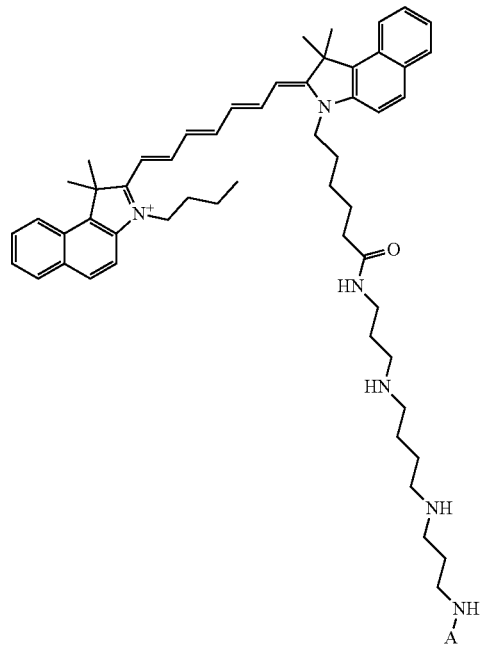 |
| 620 | 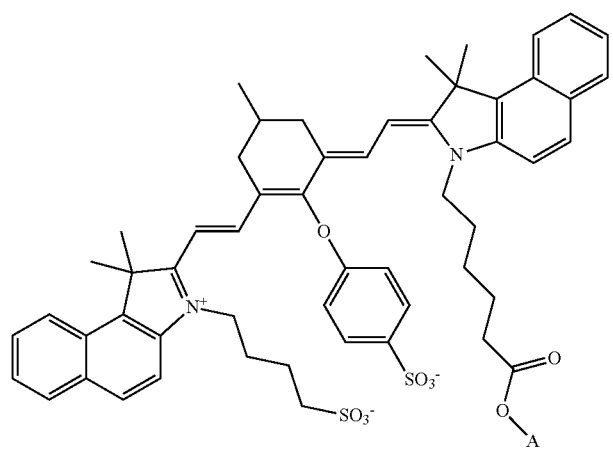 |
| 621 | 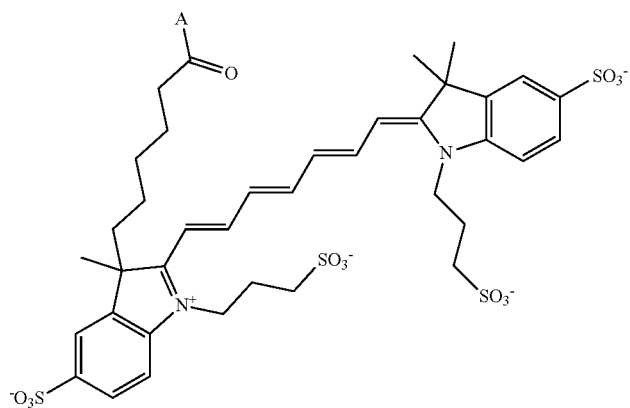 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 622 | 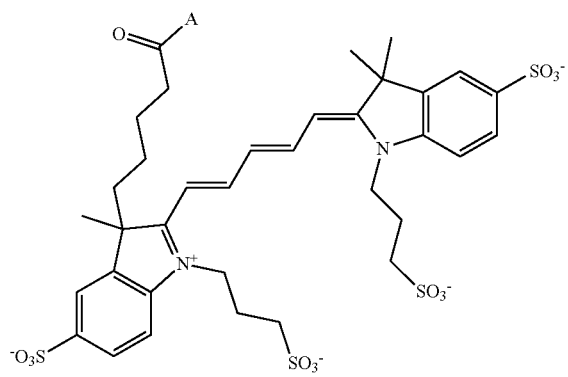 |
| 623 | 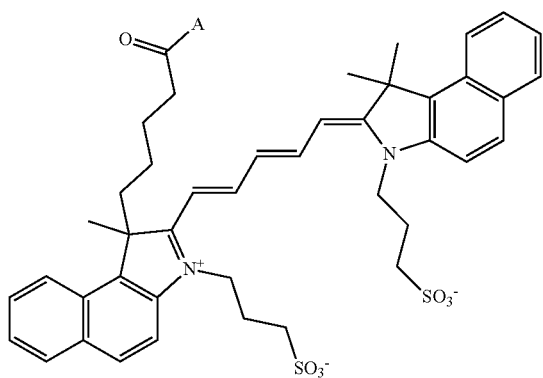 |
| 624 | 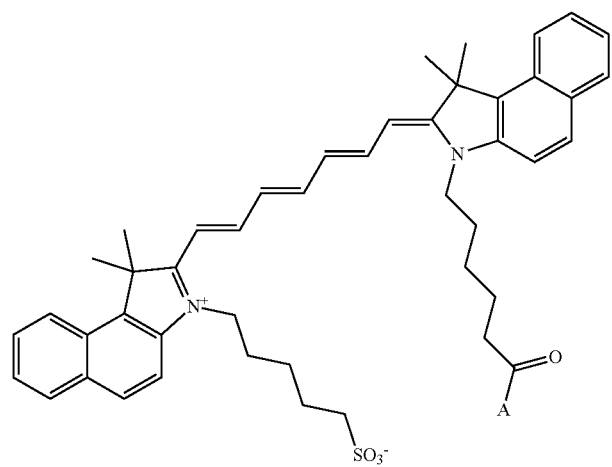 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 625 | 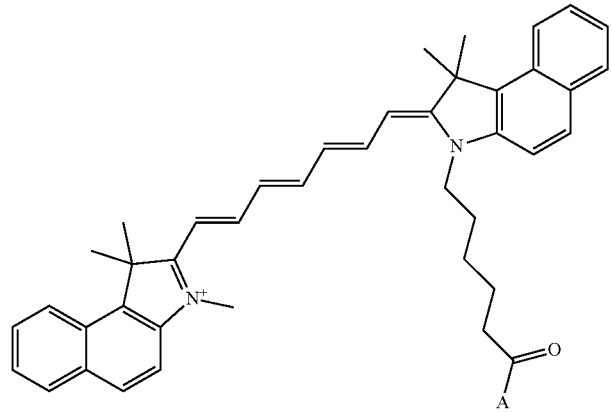 |
| 626 | 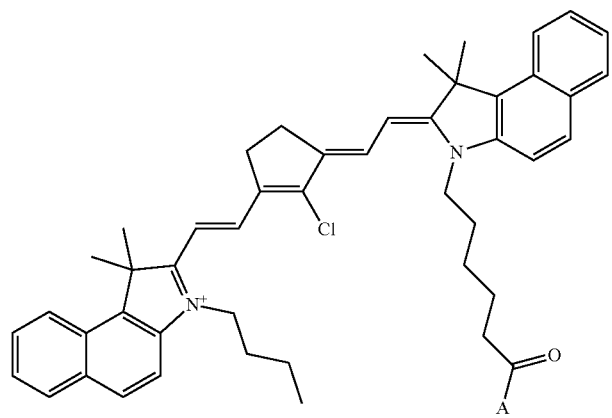 |
| 627 | 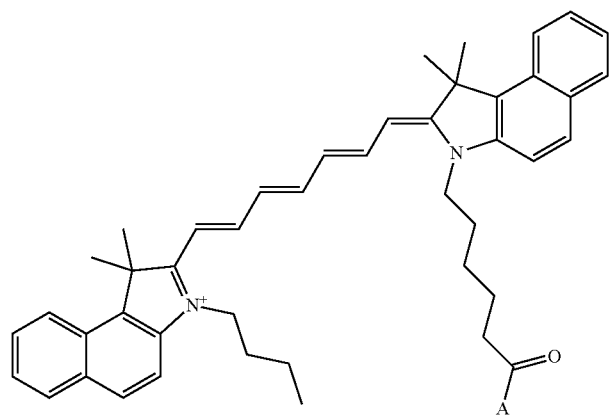 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 628 | 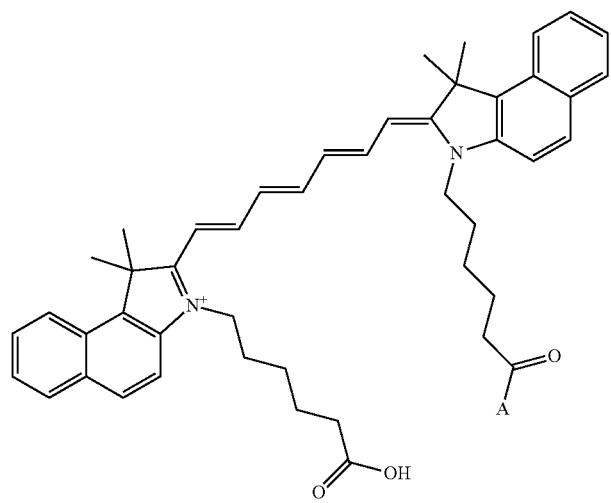 |
| 629 | 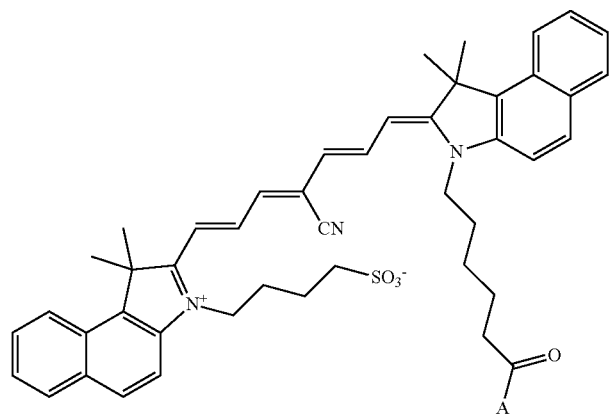 |
| 630 | 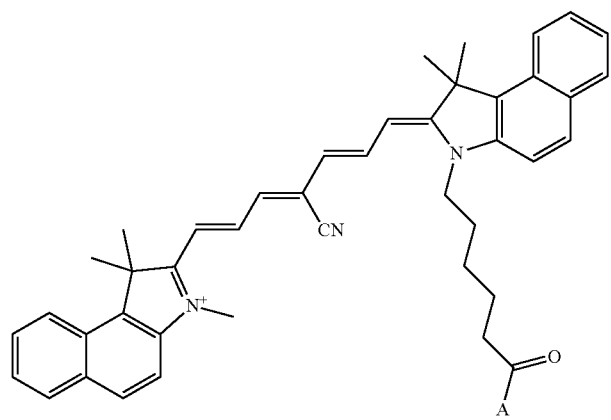 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 631 | 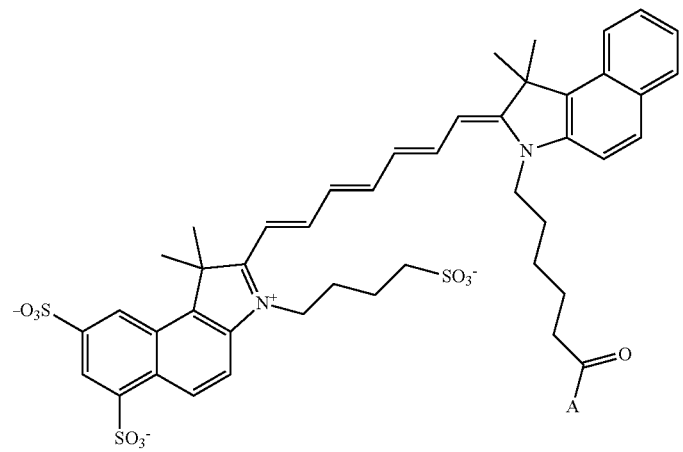 |
| 632 | 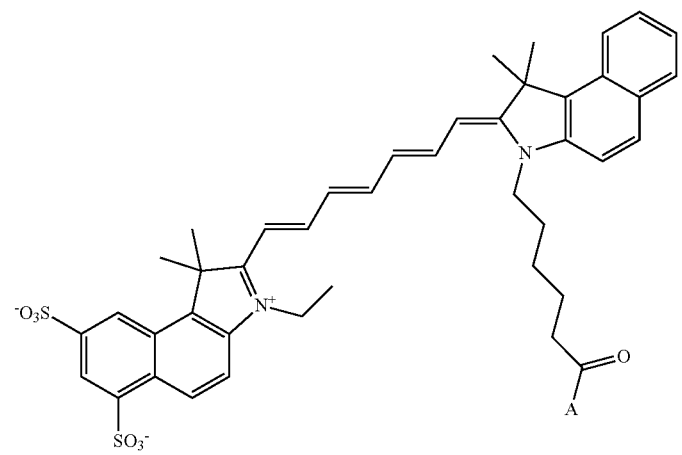 |
| 633 | 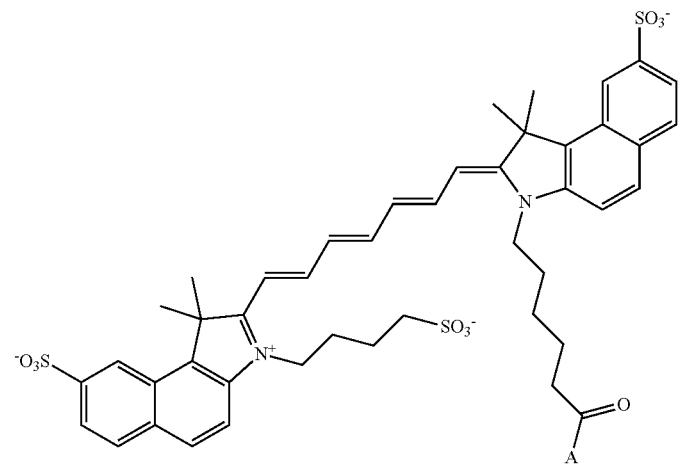 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
| --- | --- |
634
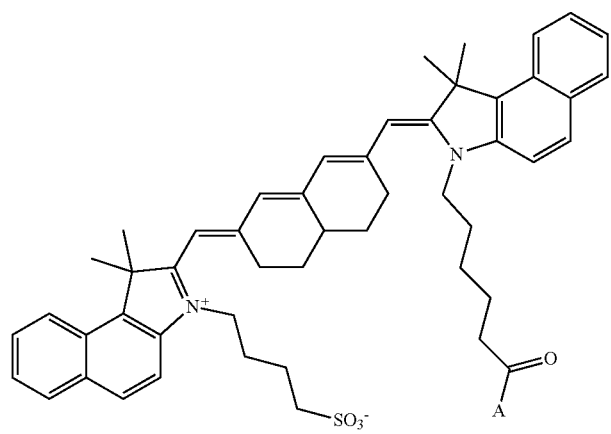
635
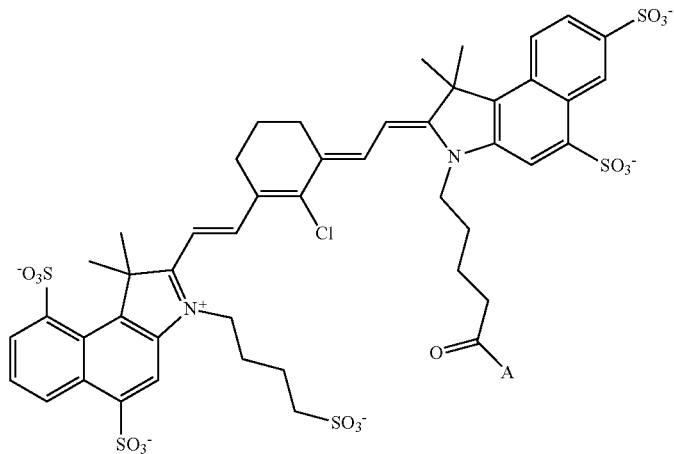
636
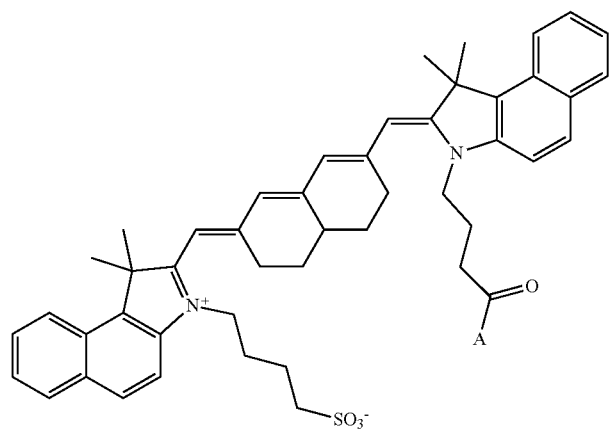

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
| --- | --- |
637
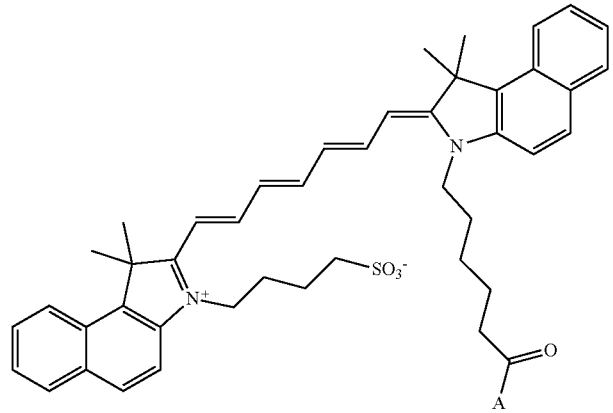
638
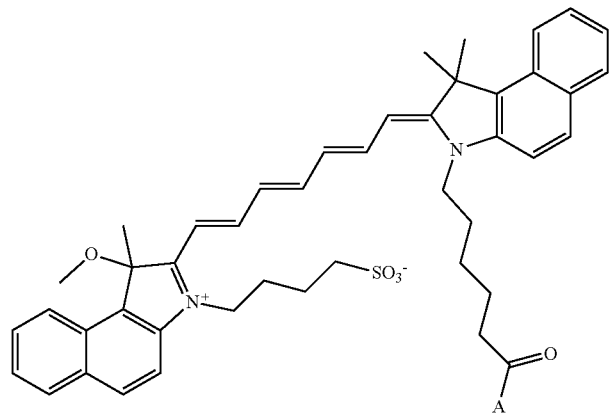
639
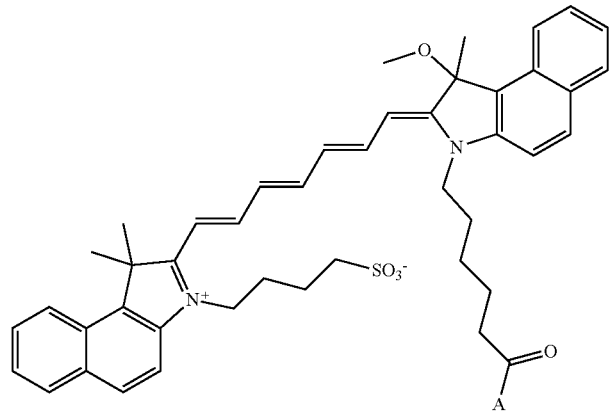

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 640 | 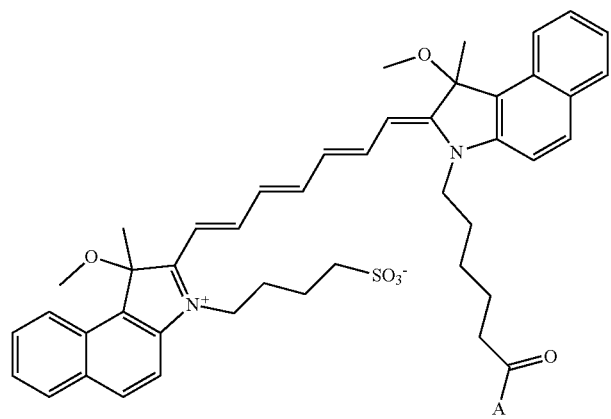 |
| 641 | 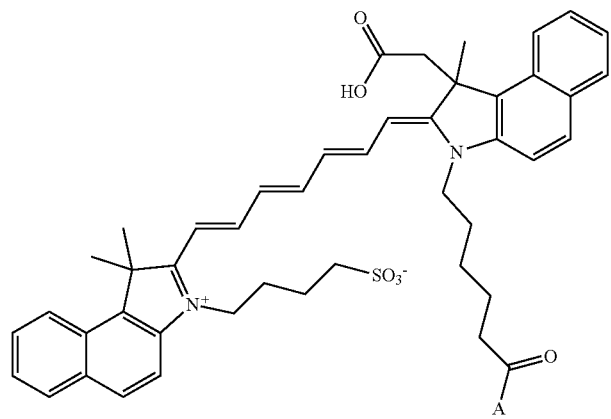 |
| 642 | 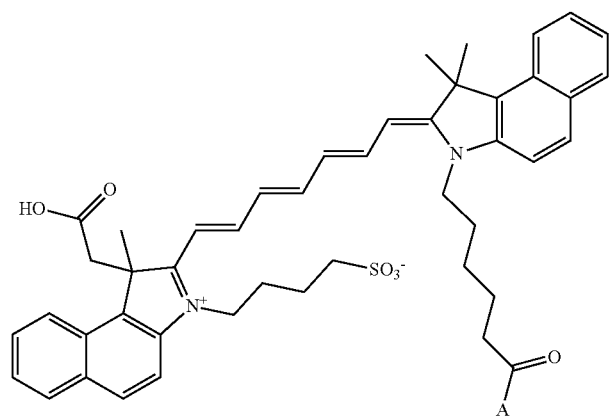 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 643 | 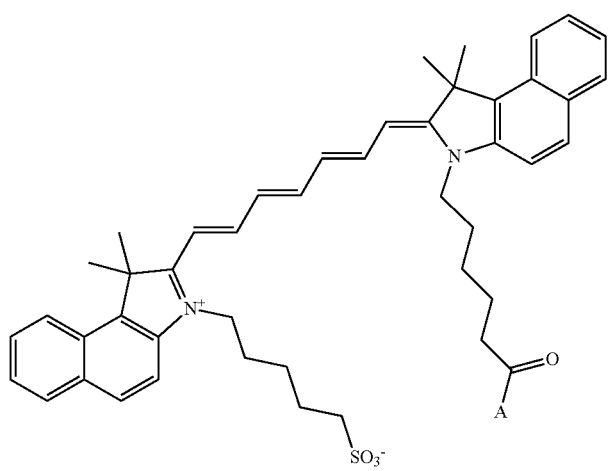 |
| 644 | 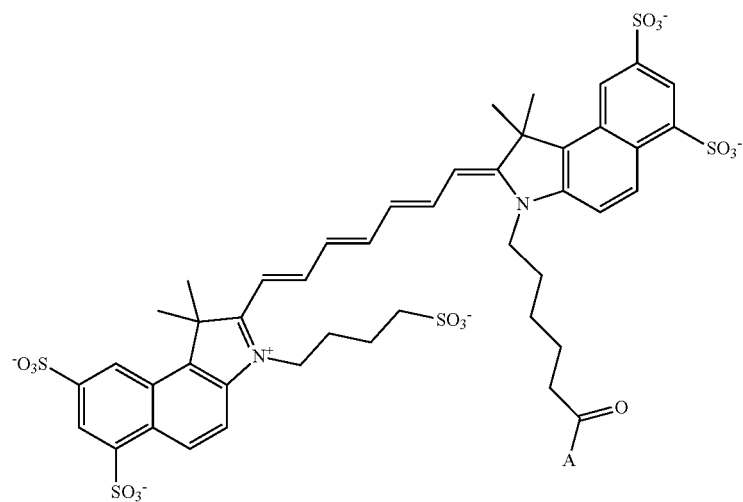 |
| 645 | 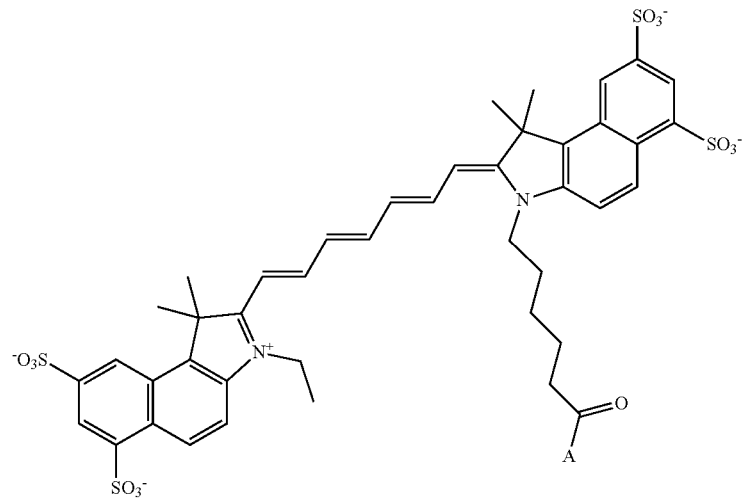 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 646 | 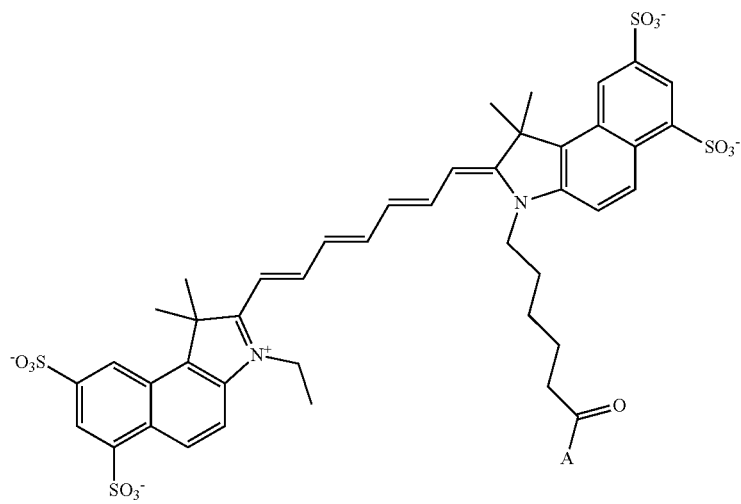 |
| 647 | 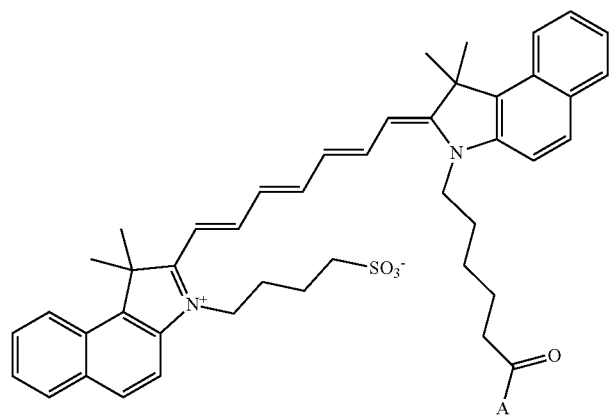 |
| 648 | 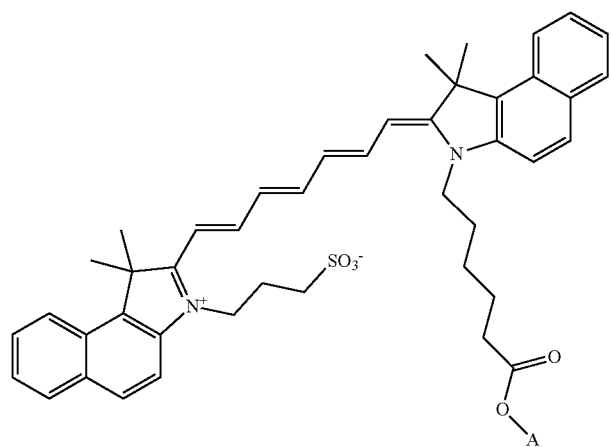 |

TABLE 12-continued
Exemplary compounds according to the present disclosure.
A = MCMPCFTTDHQMARKCDDCCGGAGRGRCYGPQCLC (SEQ ID NO: 22) (attached at K-15)
| No. | Structure |
|---|---|
| 649 | 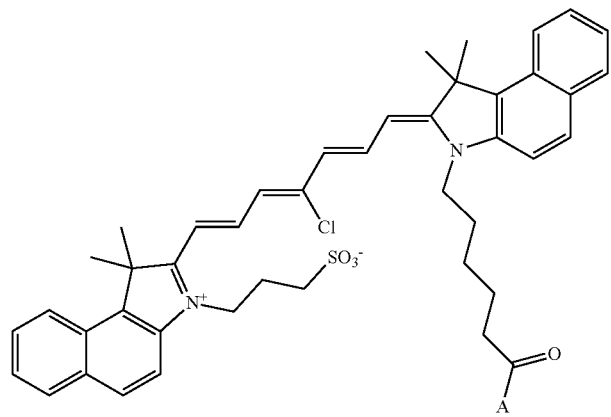 |
| 650 | 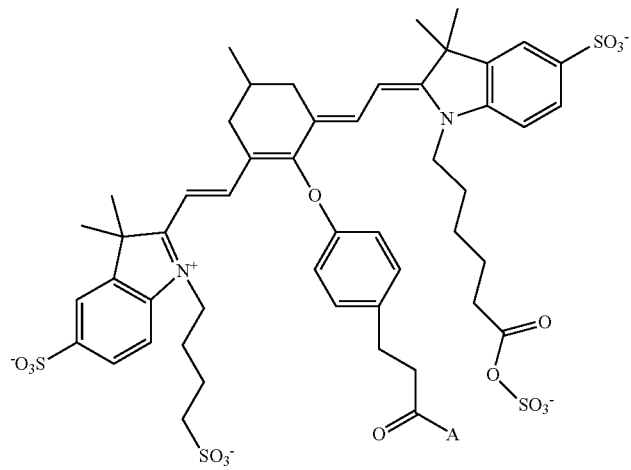 |

TABLE 13
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 651 | 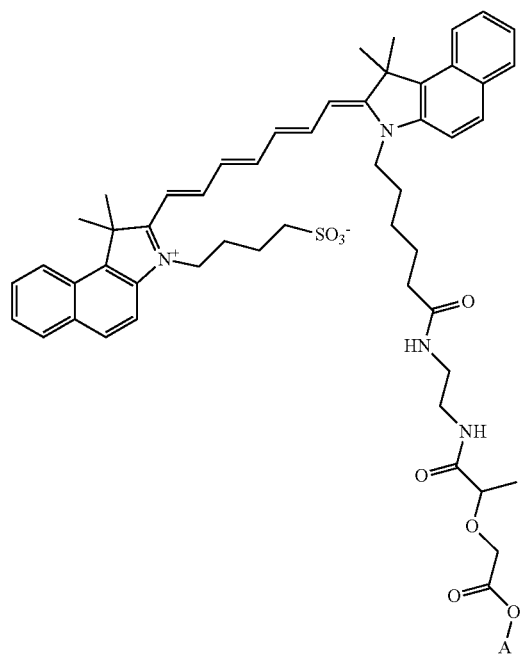 |
| 652 | 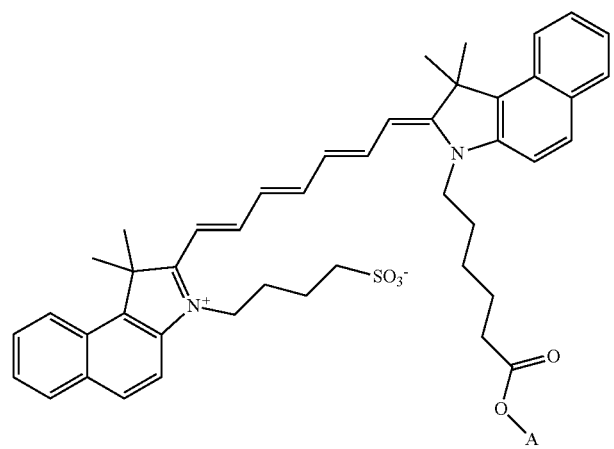 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
| --- | --- |
| 653 | 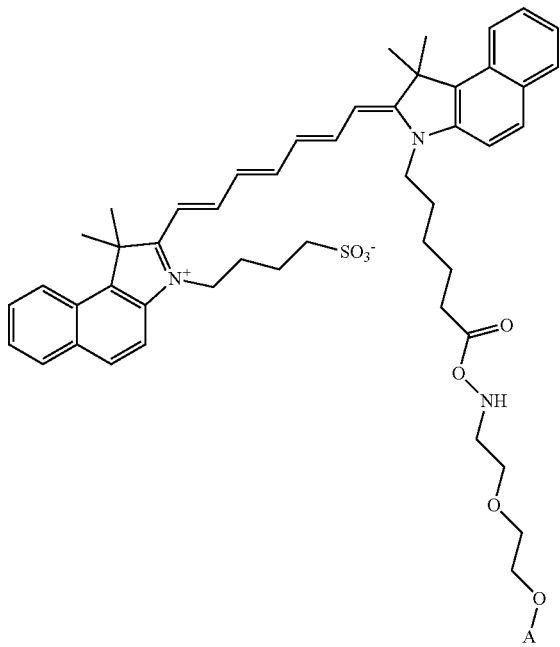 |
| 654 | 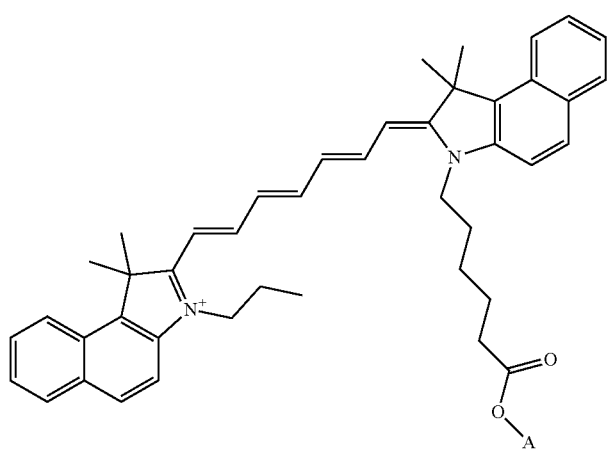 |
| 655 | 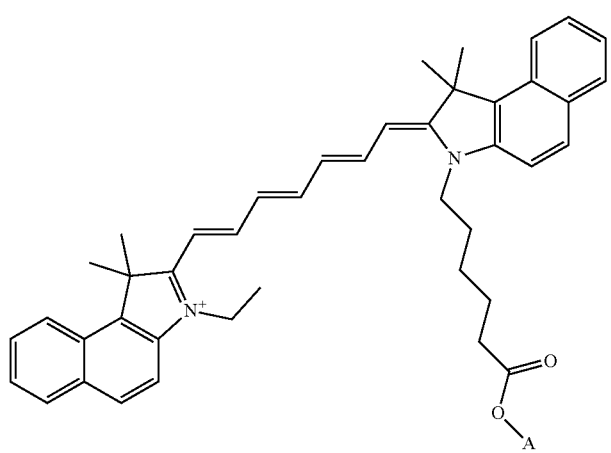 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 656 | 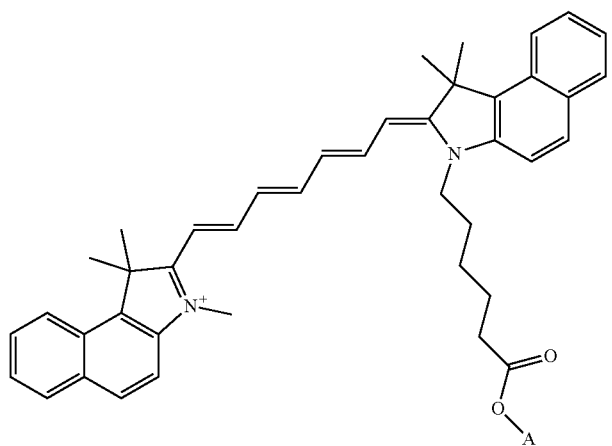 |
| 657 | 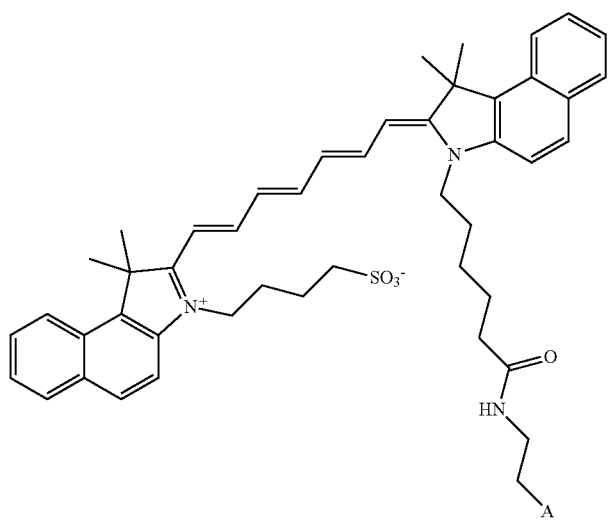 |
| 658 | 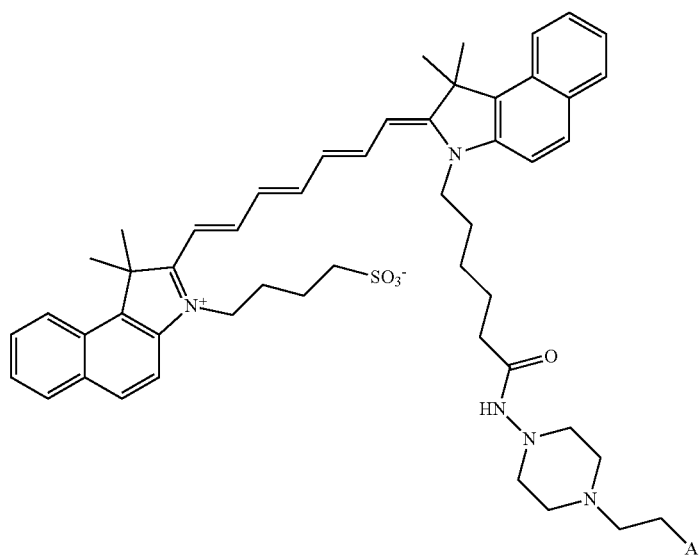 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 659 | 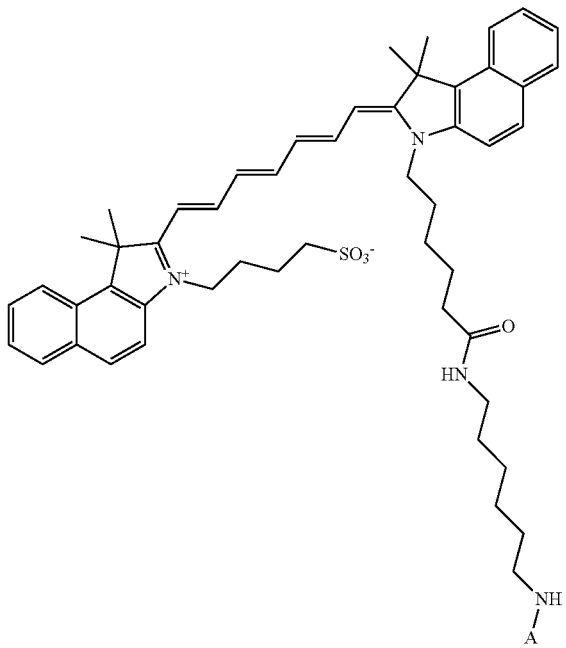 |
| 660 | 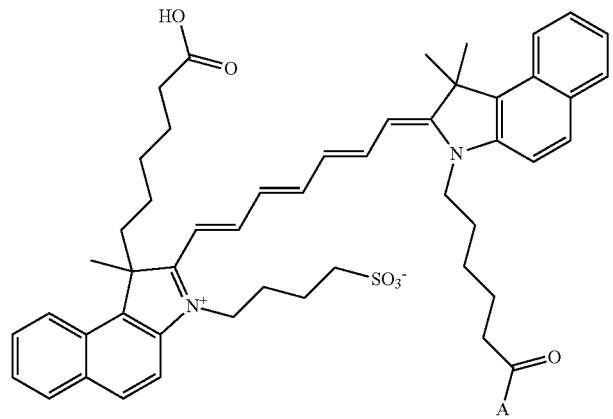 |
| 661 | 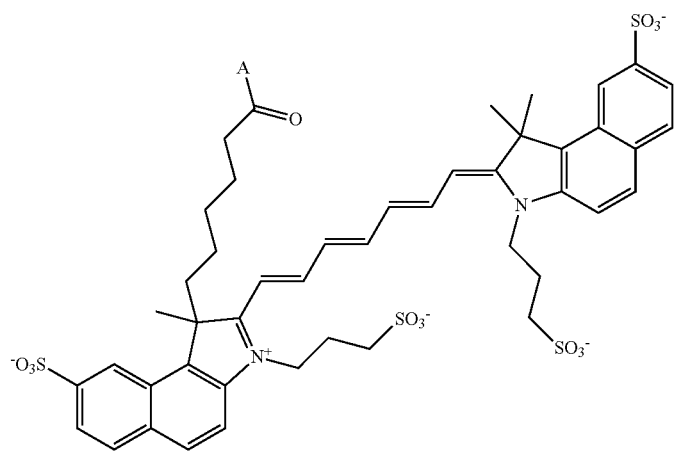 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 662 | 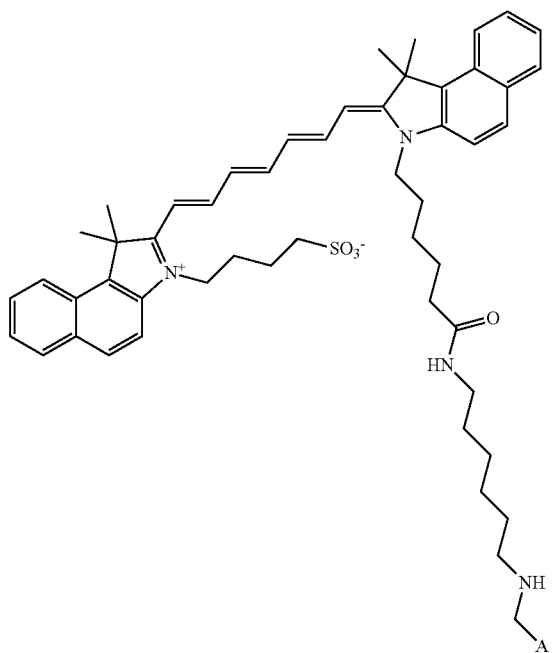 |
| 663 | 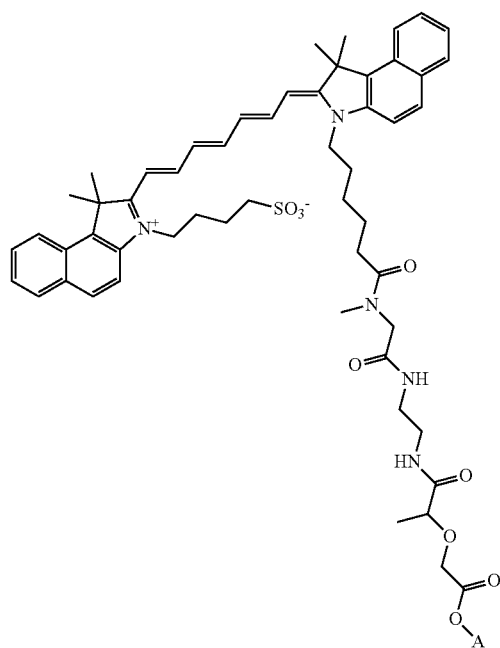 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 664 | 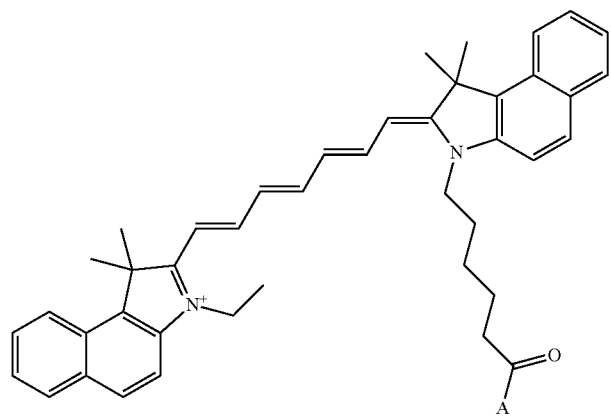 |
| 665 | 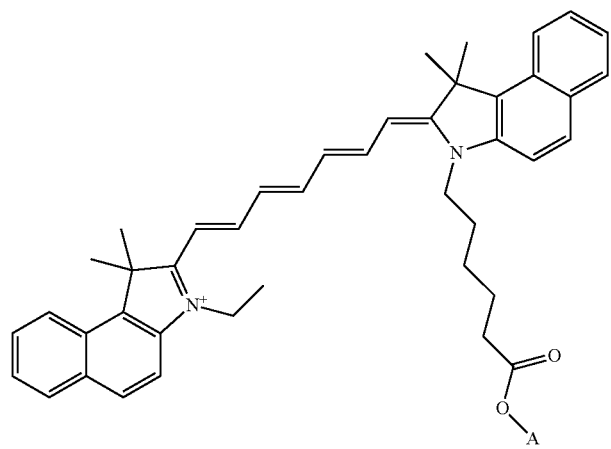 |
| 666 | 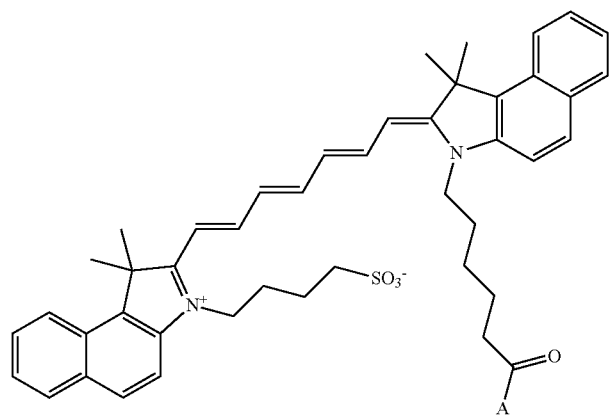 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 667 | 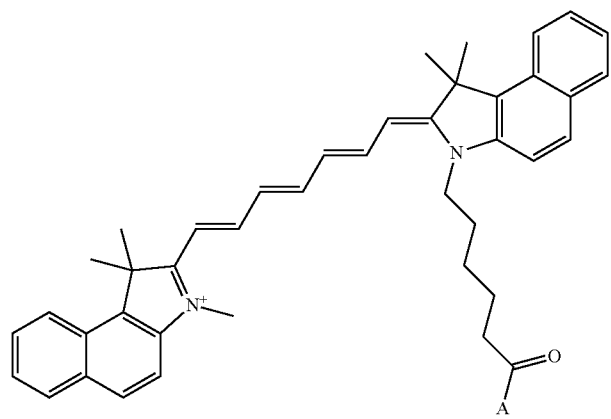 |
| 668 | 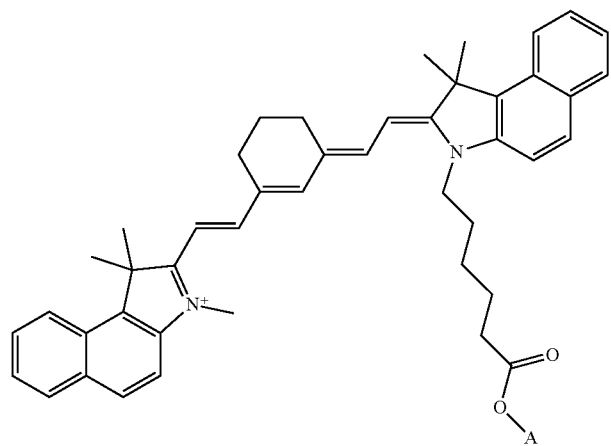 |
| 669 | 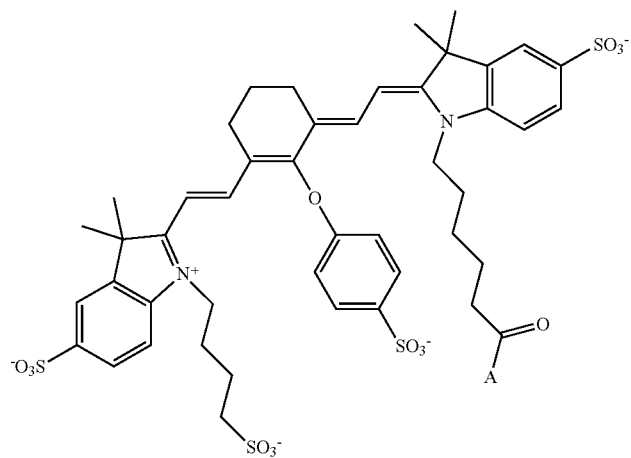 |

TABLE 13-continued

Exemplary compounds according to the present disclosure.
A = MCMPCFTTDHQMARKCDDCCGGRGRGRCYGPQCLCR (SEQ ID NO: 25) (attached at K-15)

| No. | Structure |
|-----|-----------|
| 670 | 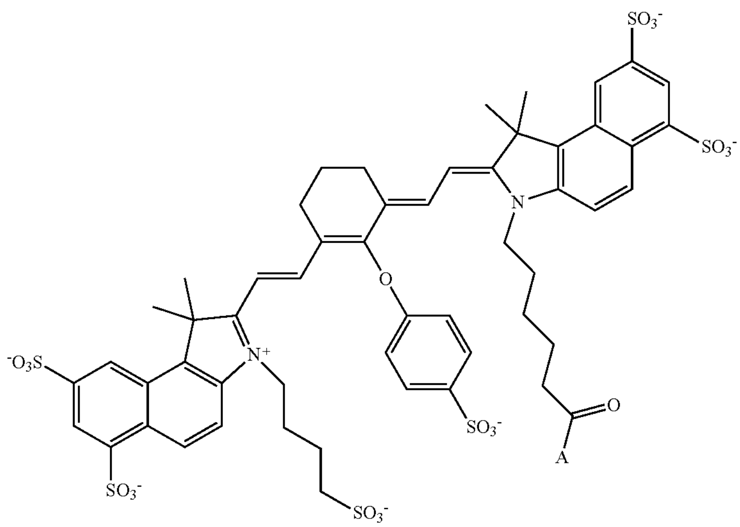 |
| 671 | 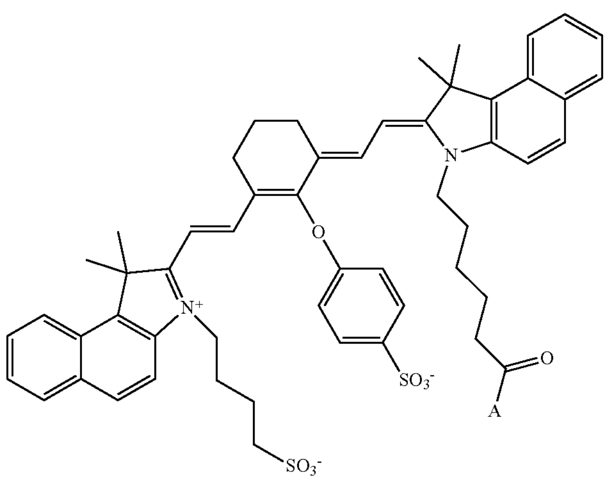 |
| 672 | 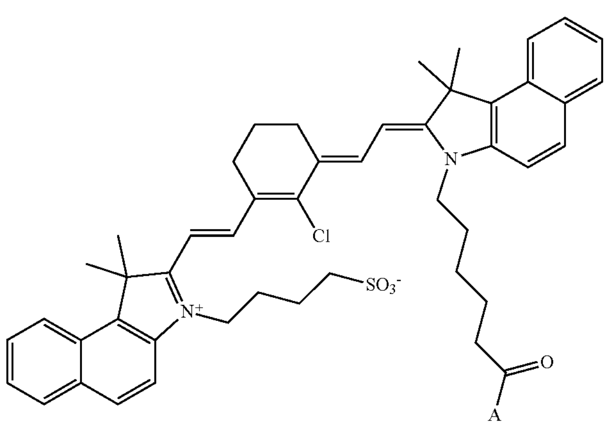 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 673 | 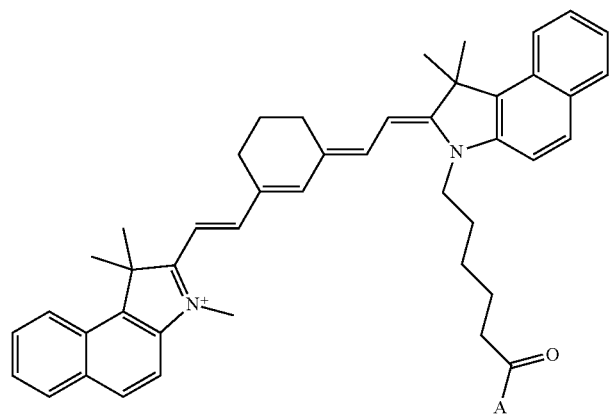 |
| 674 | 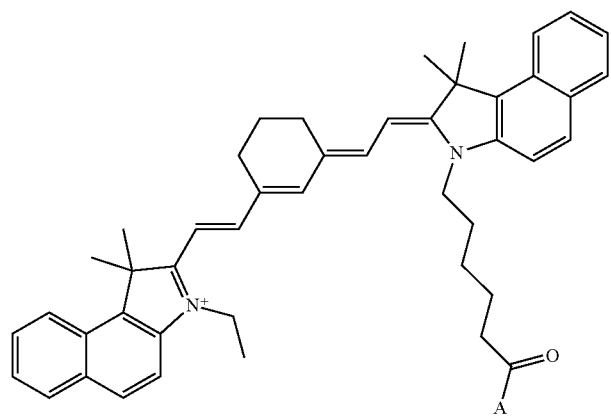 |
| 675 | 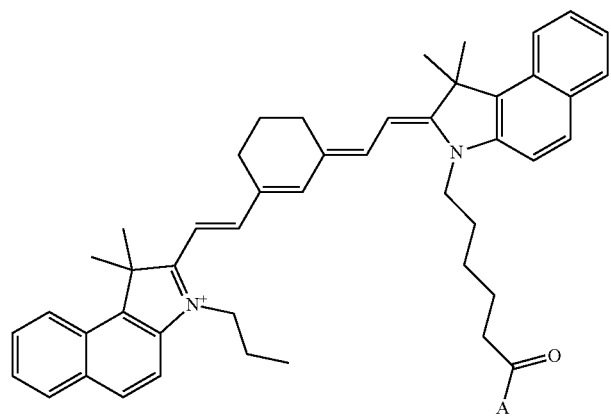 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 676 | 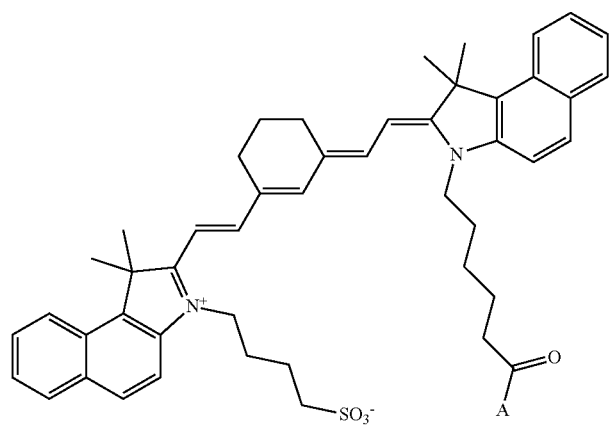 |
| 677 | 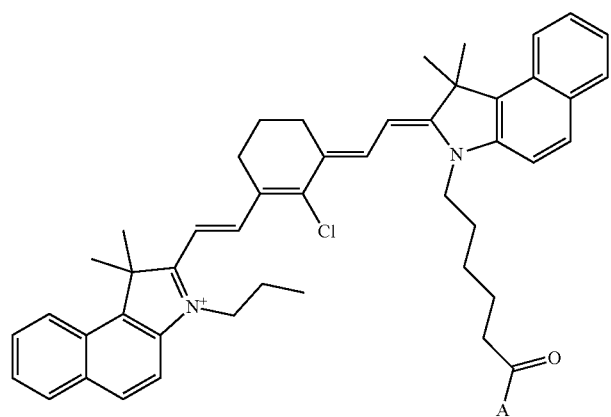 |
| 678 | 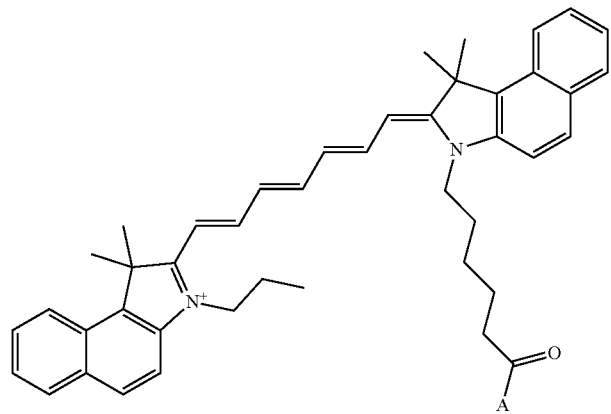 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 679 | 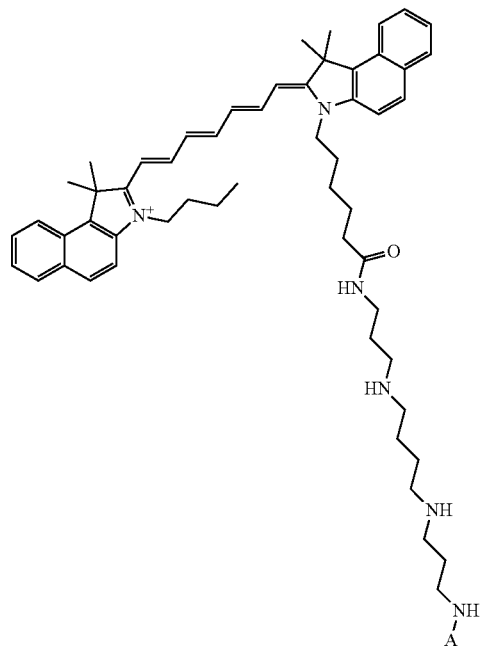 |
| 680 | 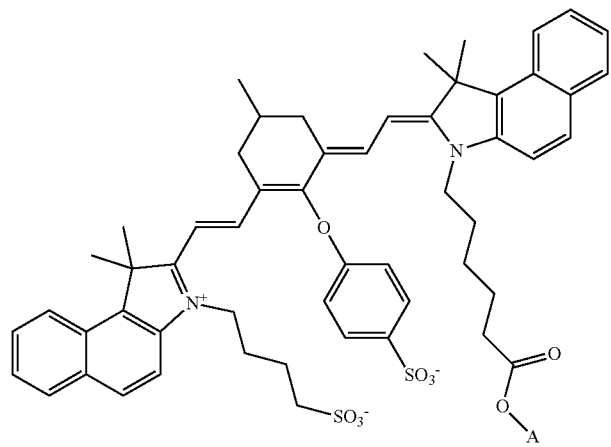 |
| 681 | 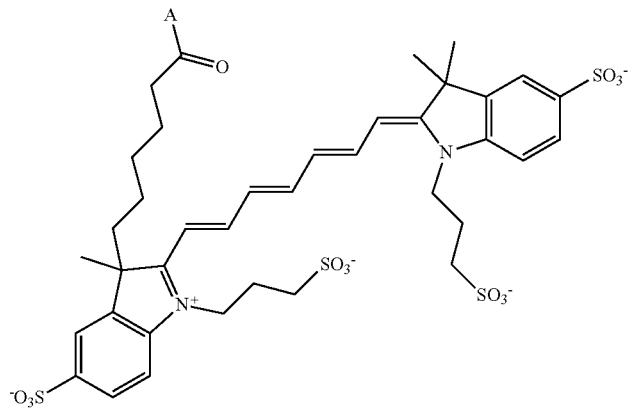 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|-----|-----------|
| 682 | 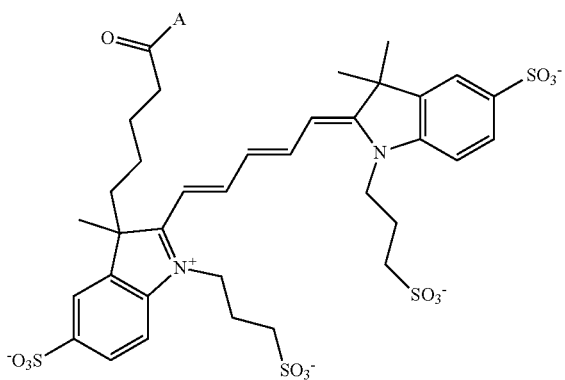 |
| 683 | 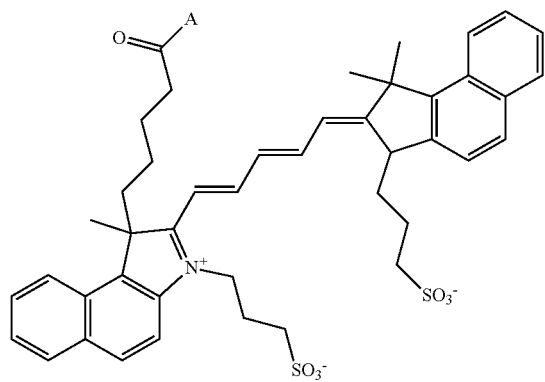 |
| 684 | 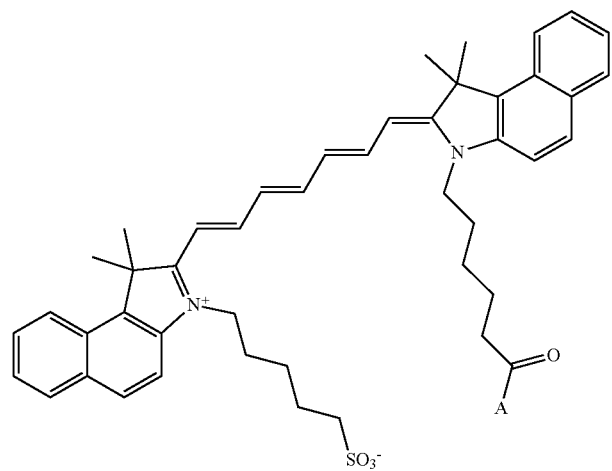 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 685 | 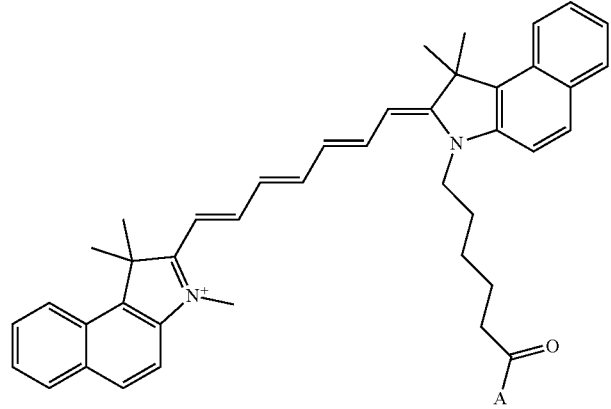 |
| 686 | 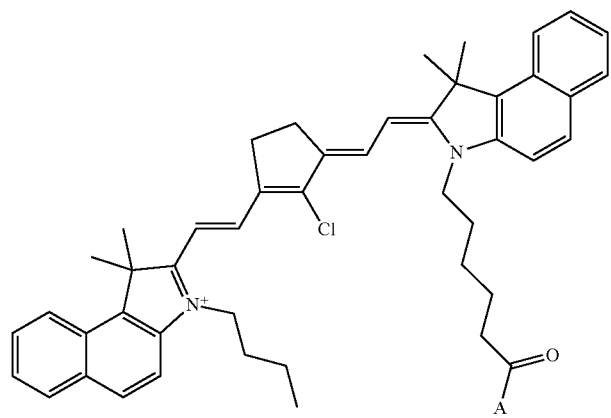 |
| 687 | 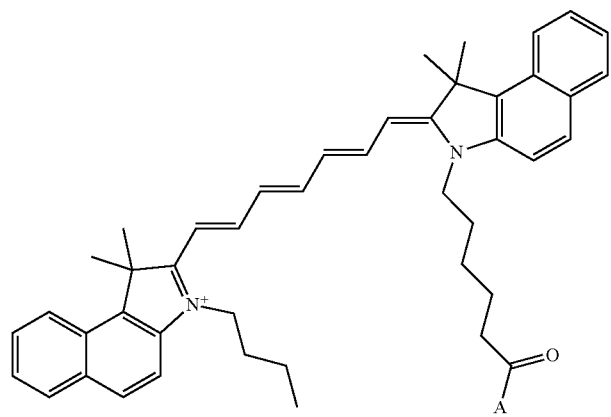 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 688 | 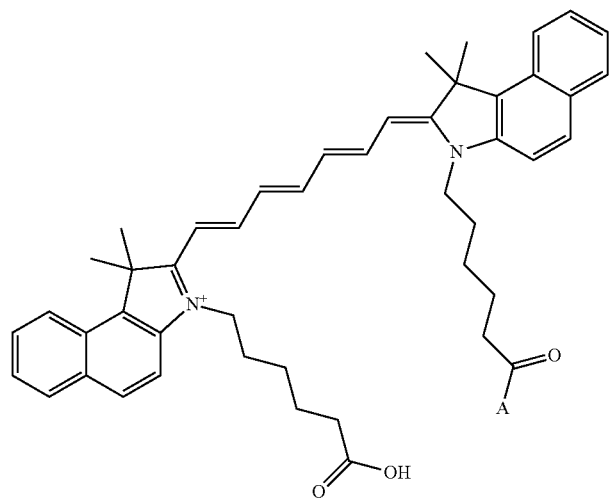 |
| 689 | 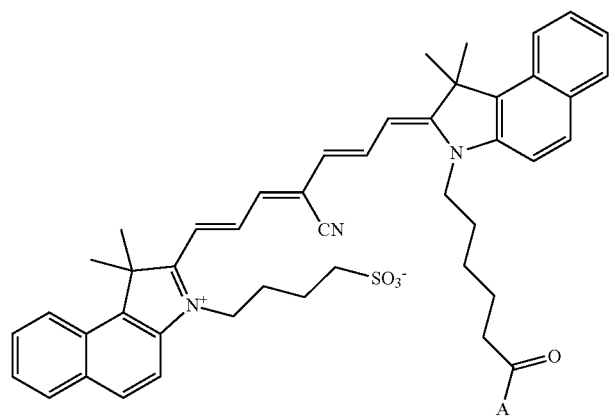 |
| 690 | 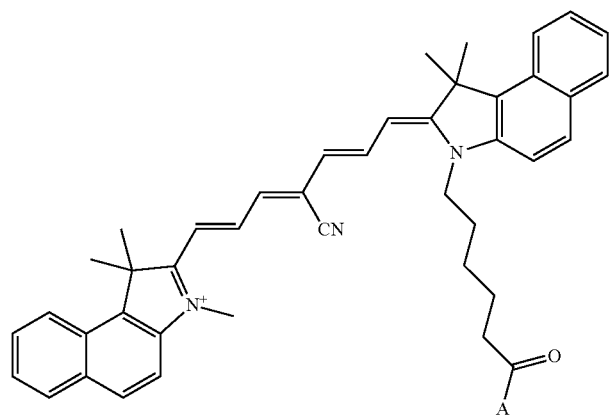 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 691 | 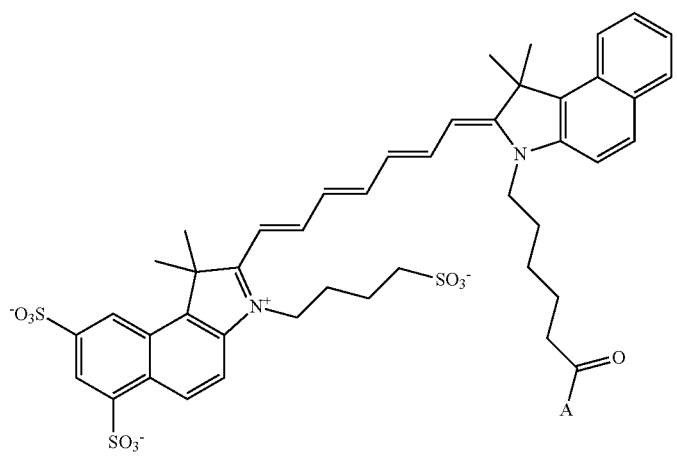 |
| 692 | 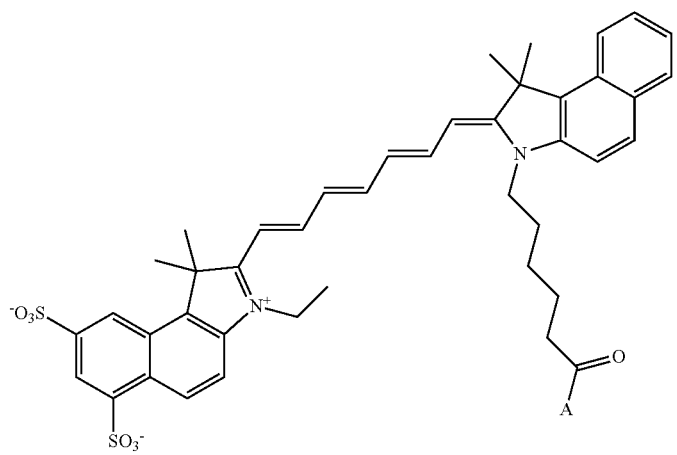 |
| 693 | 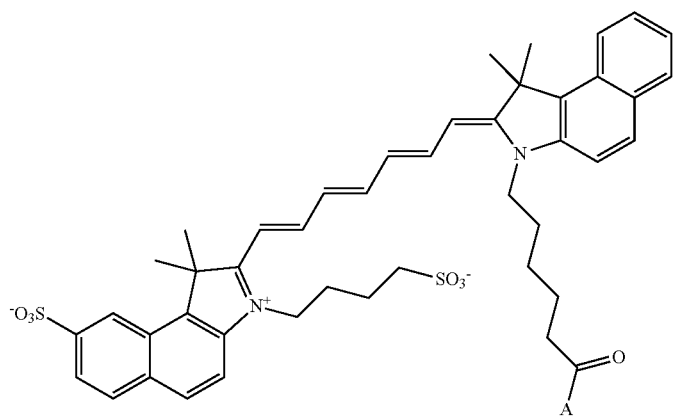 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 694 | 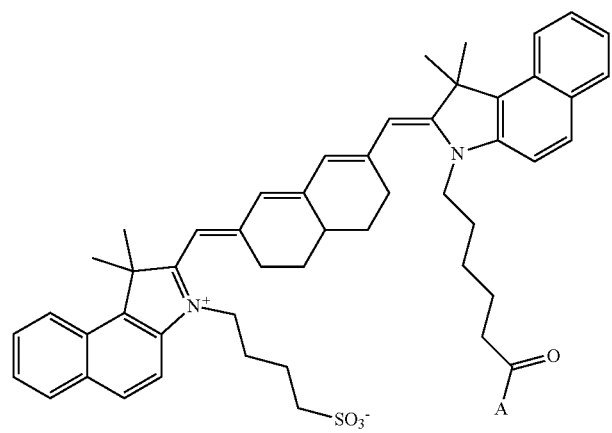 |
| 695 | 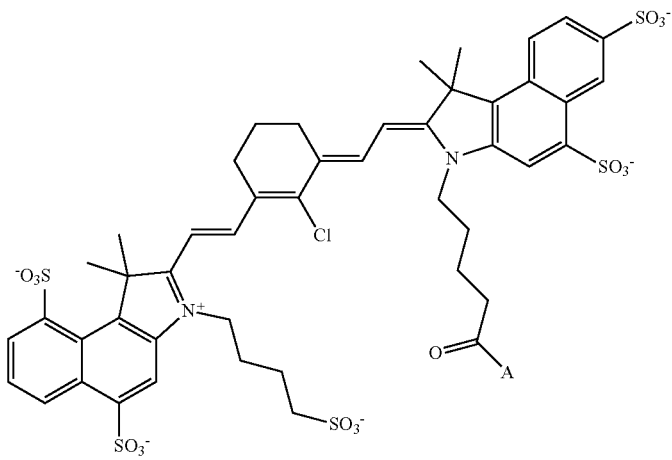 |
| 696 | 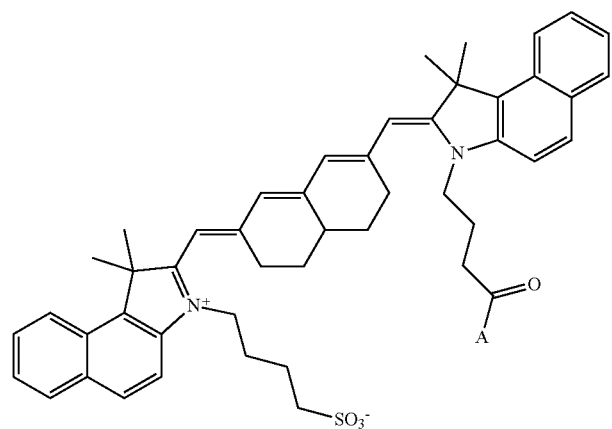 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 697 | 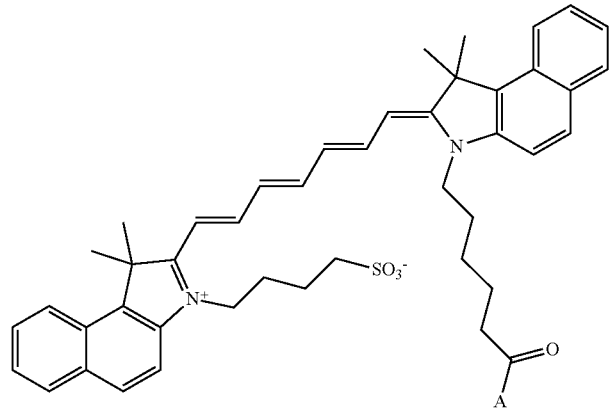 |
| 698 | 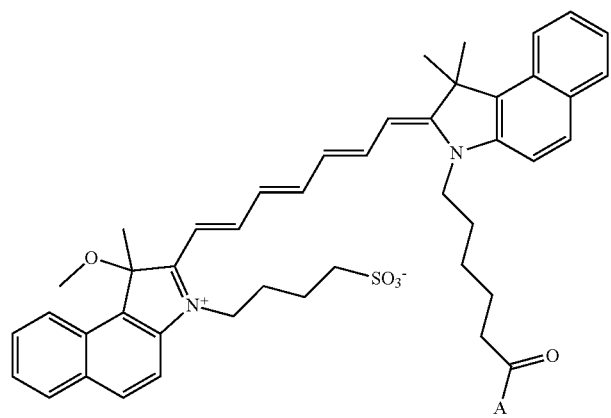 |
| 699 | 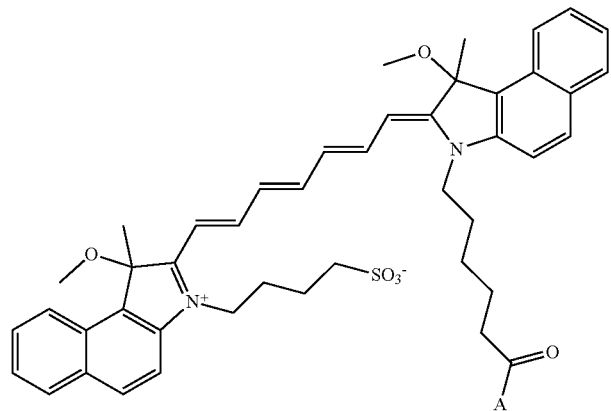 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|-----|-----------|
| 700 | 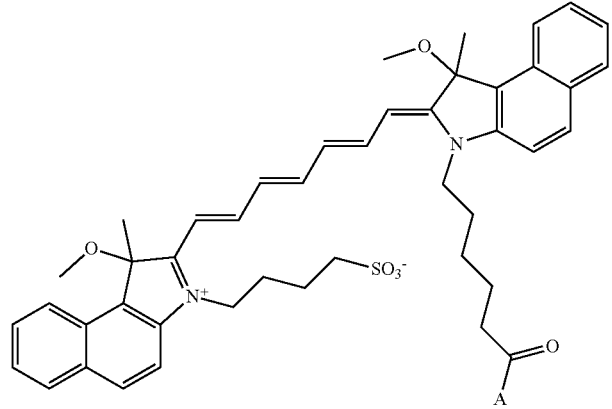 |
| 701 | 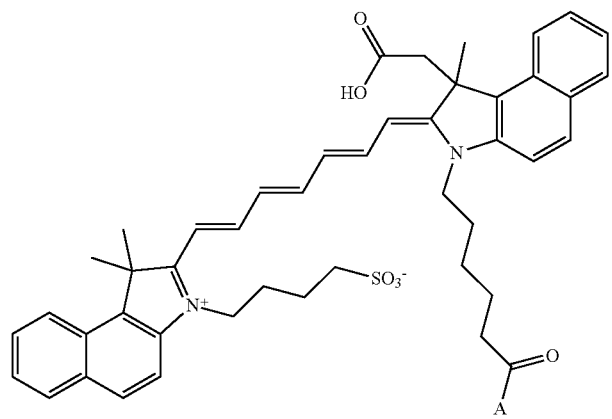 |
| 702 | 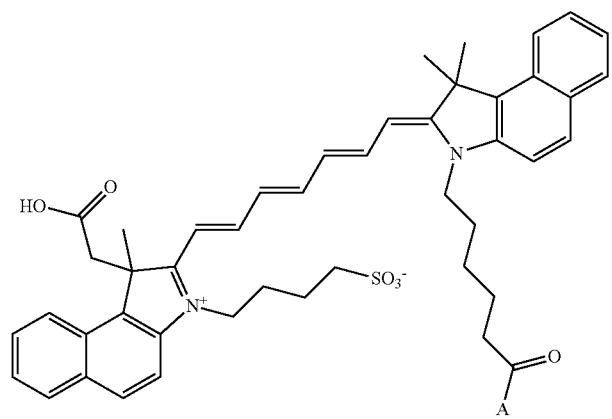 |

TABLE 13-continued
Exemplary compounds according to the present disclosure.
A = MCMPCFTTDHQMARKCDDCCGGRGRGRCYGPQCLCR (SEQ ID NO: 25) (attached at K-15)
| No. | Structure |
|---|---|
| 703 | 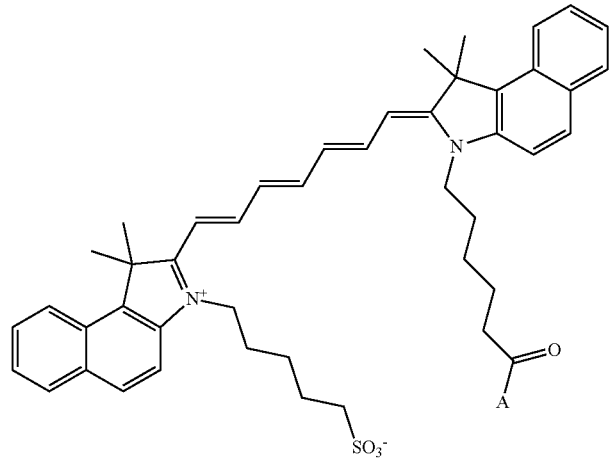 |
| 704 | 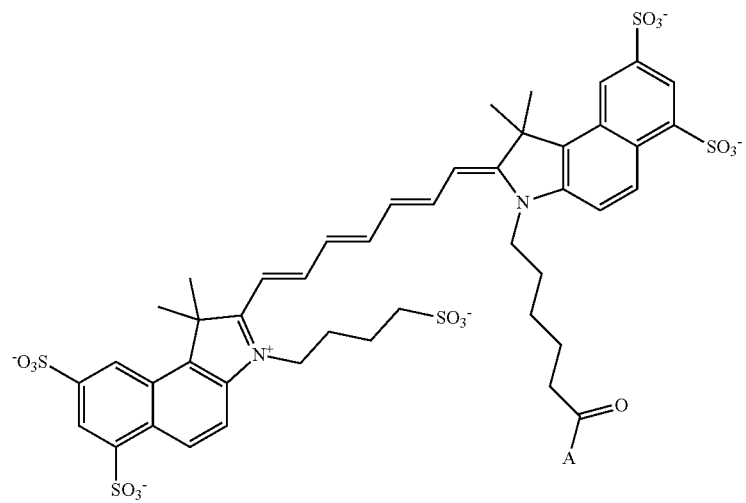 |
| 705 | 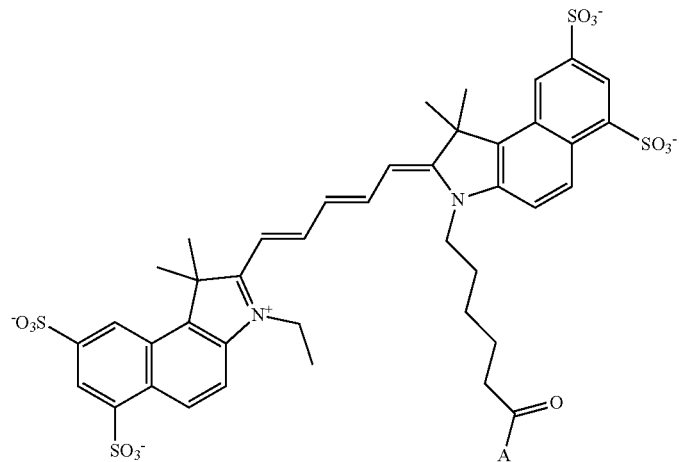 |

TABLE 13-continued

Exemplary compounds according to the present disclosure.
A = MCMPCFTTDHQMARKCDDCCGGRGRGRCYGPQCLCR (SEQ ID NO: 25) (attached at K-15)

| No. | Structure |
|---|---|
| 706 | 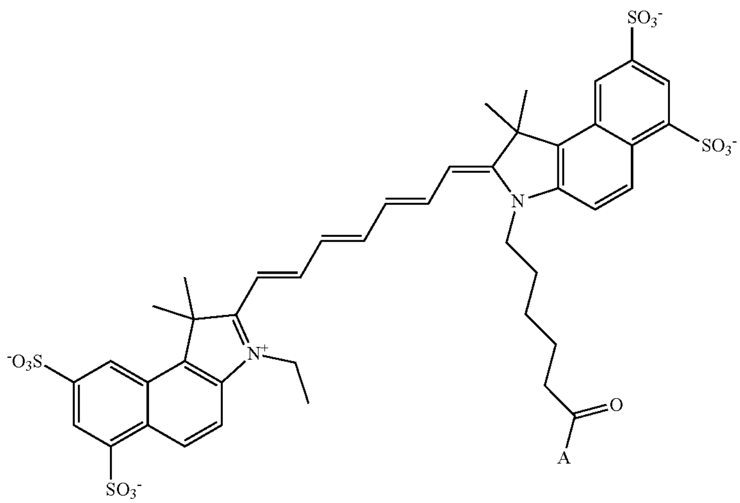 |
| 707 | 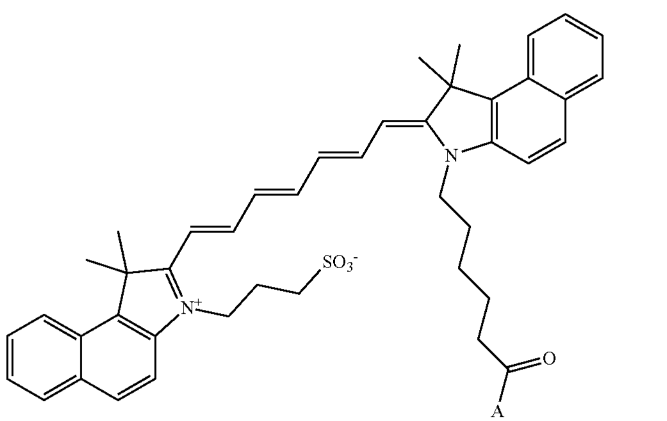 |
| 708 | 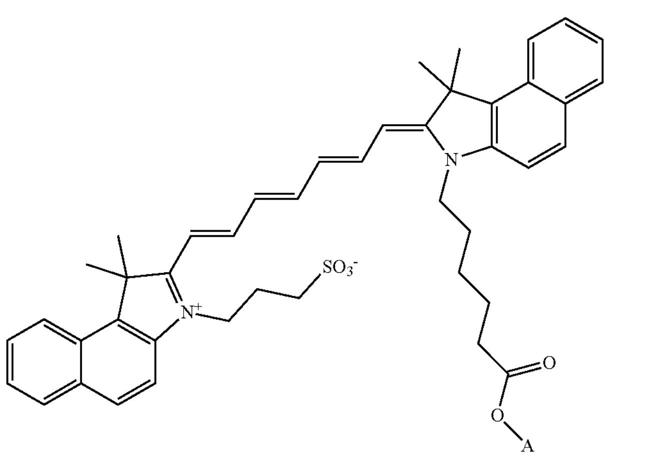 |

TABLE 13-continued

Exemplary compounds according to the present disclosure.
A = MCMPCFTTDHQMARKCDDCCGGRGRGRCYGPQCLCR (SEQ ID NO: 25) (attached at K-15)

| No. | Structure |
|-----|-----------|
| 709 | 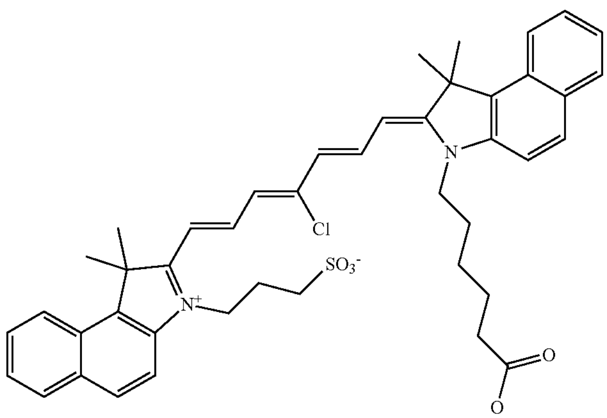 |
| 710 | 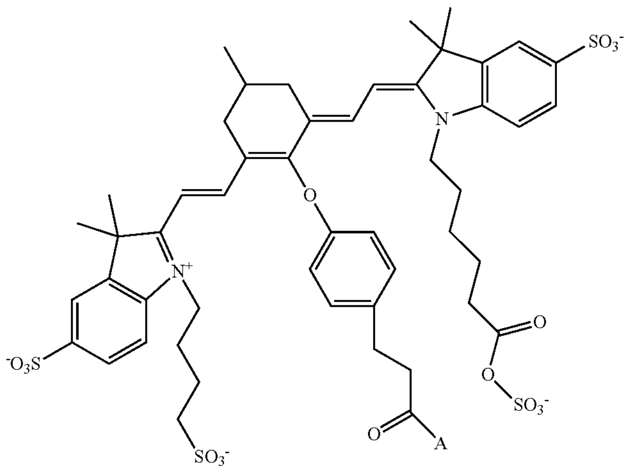 |

In certain aspects, the presently described peptides are conjugated to moieties, such as detectable labels (e.g., dyes or radiolabels) that are detected (e.g., visualized) in a subject. In some aspects, the chlorotoxin and/or chlorotoxin variants is conjugated to detectable labels to enable tracking of the bio-distribution of a conjugated peptide. The fluorescent moiety is covalently coupled to the chlorotoxin to allow for the visualization of the conjugate by fluorescence imaging, either directly or through a linker as described herein and known to one of ordinary skill in the art.

In some aspects, the fluorescent label has emission characteristics that are desired for a particular application. For example, the fluorescent label is a fluorescent dye that has a emission wavelength maximum between a range of 500 nm to 1100 nm, between a range of 600 nm to 1000 nm, between a range of 600 to 800 nm, between a range of 650 nm to 850 nm, or between a range of 700 nm to 800 nm. For another example, the fluorescent label is a fluorescent dye that has a emission wavelength maximum between a range of about 500 nm to about 1100 nm, between a range of about 600 nm to about 1000 nm, between a range of about 600 to about 800 nm, between a range of about 650 nm to about 850 nm, or between a range of about 700 nm to about 800 nm. One of ordinary skill in the art will appreciate the various dyes that are used as detectable labels and that have the emission characteristics above.

Some other exemplary dyes include near-infrared dyes, such as, but not limited to, DyLight-680, DyLight-750, VivoTag-750, DyLight-800, IRDye-800, VivoTag-680, Cy5.5, or indocyanine green (ICG). In some aspects, near infrared dyes often include cyanine dyes. Additional non-limiting examples of fluorescent dyes for use as a conjugating molecule in the present disclosure include acradine orange or yellow, Alexa Fluors and any derivative thereof, 7-actinomycin D, 8-anilinonaphthalene-1-sulfonic acid, ATTO dye and any derivative thereof, auramine-rhodamine stain and any derivative thereof, bensantrhone, bimane, 9-10-bis(phenylethynyl)anthracene, 5,12-bis(phenylethynyl)naththacene, bisbenzimide, brainbow, calcein, carbodyfluorescein and any derivative thereof, 1-chloro-9,10-bis(phenylethynyl)anthracene and any derivative thereof, DAPI, DiOC6, DyLight Fluors and any derivative thereof, epicocconone, ethidium bromide, FlAsH-EDT2, Fluo dye and any derivative thereof, FluoProbe and any derivative thereof, Fluorescein and any derivative thereof, Fura and any derivative thereof, GelGreen and any derivative thereof, GelRed and any derivative thereof, fluorescent proteins and any derivative thereof, m isoform proteins and any derivative thereof such as for example mCherry, hetamethine dye and any derivative thereof, hoeschst stain, iminocoumarin, indian yellow, indo-1 and any derivative thereof, laurdan, lucifer yellow and any derivative thereof, luciferin and any derivative thereof, luciferase and any derivative thereof, mercocyanine and any derivative thereof, nile dyes and any derivative thereof, perylene, phloxine, phyco dye and any derivative thereof, propium iodide, pyranine, rhodamine and any derivative thereof, ribogreen, RoGFP, rubrene, stilbene and any derivative thereof, sulforhodamine and any derivative thereof, SYBR and any derivative thereof, synaptopHluorin, tetraphenyl butadiene, tetrasodium tris, Texas Red, Titan Yellow, TSQ, umbelliferone, violanthrone, yellow fluorescent protein and YOYO-1. Other Suitable fluorescent dyes include, but are not limited to, fluorescein and fluorescein dyes (e.g., fluorescein isothiocyanine or FITC, naphthofluorescein, 4',5'-dichloro-2',7'-dimethoxyfluorescein, 6-carboxyfluorescein or FAM, etc.), carbocyanine, merocyanine, styryl dyes, oxonol dyes, phycoerythrin, erythrosin, eosin, rhodamine dyes (e.g., carboxytetramethylrhodamine or TAMRA, carboxyrhodamine 6G, carboxy-X-rhodamine (ROX), lissamine rhodamine B, rhodamine 6G, rhodamine Green, rhodamine Red, tetramethylrhodamine (TMR), etc.), coumarin and coumarin dyes (e.g., methoxycoumarin, dialkylaminocoumarin, hydroxycoumarin, aminomethylcoumarin (AMCA), etc.), Oregon Green Dyes (e.g., Oregon Green 488, Oregon Green 500, Oregon Green 514, etc.), Texas Red, Texas Red-X, SPECTRUM RED, SPECTRUM GREEN, cyanine dyes (e.g., CY-3, Cy-5, CY-3.5, CY-5.5, etc.), ALEXA FLUOR dyes (e.g., ALEXA FLUOR 350, ALEXA FLUOR 488, ALEXA FLUOR 532, ALEXA FLUOR 546, ALEXA FLUOR 568, ALEXA FLUOR 594, ALEXA FLUOR 633, ALEXA FLUOR 660, ALEXA FLUOR 680, etc.), BODIPY dyes (e.g., BODIPY FL, BODIPY R6G, BODIPY TMR, BODIPY TR, BODIPY 530/550, BODIPY 558/568, BODIPY 564/570, BODIPY 576/589, BODIPY 581/591, BODIPY 630/650, BODIPY 650/665, etc.), IRDyes (e.g., IRD40, IRD 700, IRD 800, etc.), and the like. In some aspects, conjugates of the present disclosure comprise other dyes, including but not limited to those provided below in Table 14.

| Dye | Peak Abs. | Peak Em. |
| --- | --- | --- |
| Methoxycoumarin | 360 | 410 |
| Fluospheres Blue | 356 | 412 |
| Cascade Blue | 377 | 420 |
| PBFI | 360 | 420 |
| DyeLight 405 | 400 | 420 |
| Cascade Blue | 400 | 420 |
| Alexa Fluor 405 | 401 | 421 |
| Alexa Fluor 405 | 401 | 421 |
| LysoTracker Blue | 373 | 422 |
| LysoSensor Blue | 374 | 424 |
| AMCA | 345 | 425 |
| True Blue | 365 | 425 |
| 7-amino-4-methylcoumarin (AMC) | 351 | 430 |
| Phorwite AR | 360 | 430 |
| DyLight 350 | 353 | 432 |
| Uvitex SFC | 365 | 435 |
| 4-methylumbelliferone | 360 | 440 |
| CellTrace Calcein Blue | 373 | 440 |
| Calcofluor White | 350 | 440 |
| Fast Blue | 360 | 440 |
| LysoSensor Yellow/Blue (pH 8.0) | 329 | 440 |
| LysoSensor Yellow/Blue (pH 8.0) | 329 | 440 |
| LysoSensor Yellow/Blue (pH 8.0) | 329 | 440 |
| LysoSensor Yellow/Blue (pH 8.0) | 329 | 440 |
| Alexa Fluor 350 | 346 | 442 |
| AMCA-X | 353 | 442 |
| LIVE/DEAD Fixable Blue Dead Cell Stain | 344 | 442 |
| Thiolyte | 378 | 483 |
| SYTO 45 | 452 | 484 |
| SYTO 45 | 452 | 484 |
| SYTO 45 | 452 | 484 |
| SYTO 45 | 452 | 484 |
| SYTO 45 | 452 | 484 |
| Hoechst 33258 | 345 | 487 |
| AmCyan | 548 | 489 |
| Auramine O | 445 | 500 |
| SYTO 9 | 482 | 500 |
| SYTO 9 | 482 | 500 |
| SYTO 9 | 482 | 500 |
| SYTO 9 | 482 | 500 |
| SYTO 9 | 482 | 500 |
| DiO | 484 | 501 |
| DiO | 484 | 501 |
| DiO | 484 | 501 |
| LysoSensor Green | 448 | 503 |
| LysoSensor Green | 448 | 503 |
| LysoSensor Green | 448 | 503 |
| LysoSensor Green | 448 | 503 |
| LysoSensor Green | 448 | 503 |
| SYTO 13 | 487 | 505 |
| LysoSensor Green (pH 5) | 442 | 505 |
| SYTO 13 | 487 | 505 |
| SYTO 13 | 487 | 505 |
| SYTO 13 | 487 | 505 |
| SYTO 13 | 487 | 505 |
| DiO (Vybrant DiO) | 489 | 506 |
| HCS LipidTox Green | 498 | 506 |
| LIVE/DEAD Fixable Green | 498 | 506 |
| LIVE/DEAD Fixable Green | 498 | 506 |
| ATTO 465 | 453 | 507 |
| CellLights GFP | 488 | 507 |
| Evans Blue | 460 | 515 |
| rsGFP (red shifted GFP, S65T) | 498 | 516 |
| CellTracker Violet BMQC | 415 | 516 |
| HCS CellMask Green | 493 | 516 |
| CellTracker Violet BMQC | 415 | 516 |
| CellTracker Violet BMQC | 415 | 516 |
| CellTracker Violet BMQC | 415 | 516 |
| CellTracker Violet BMQC | 415 | 516 |
| HCS CellMask Green | 493 | 516 |
| 5-carboxyfluorescein (5-FAM) | 492 | 518 |
| ActinGreen (Alexa Fluor 488 phalloidin) | 496 | 518 |
| Alexa Fluor 488 | 496 | 518 |
| Click-iT EdU Alexa Fluor 488 | 496 | 518 |
| DyLight + C110 488 | 493 | 518 |
| Fluoro-Emerald | 494 | 518 |
| Aiexa Fluor 488 | 496 | 518 |
| Carboxyfluorescein (5-FAM) | 492 | 518 |
| Aiexa Fluor 488 | 496 | 518 |
| Carboxyfluorescein (5-FAM) | 492 | 518 |
| CellRox Green | 485 | 520 |
| FITC (Fluorescein) | 492 | 520 |
| Fluor-X | 494 | 520 |
| Rhodamine 110 | 496 | 520 |
| SYTO 16 | 490 | 520 |
| FITC | 492 | 520 |
| Rhodamine | 110 | 496 |
| SYTO 16 | 490 | 520 |
| FITC | 492 | 520 |
| Rhodamine 110 | 496 | 520 |
| SYTO 16 | 490 | 520 |
| Qdot 525 | UV | 525 |
| SYTO 11 | 506 | 525 |
| Qdot 525 | UV | 525 |
| Qdot 525 | UV | 525 |

| Dye | Peak Abs. | Peak Em. |
|---|---|---|
| Acridine Orange + DNA | 500 | 526 |
| LIVE/DEAD Fixable Green | 498 | 526 |
| Surf Green EX | 469 | 526 |
| Acridine Orange + DNA | 500 | 526 |
| Acridine Orange + DNA | 500 | 526 |
| Acridine Orange + DNA | 500 | 526 |
| Acridine Orange (+DNA) | 500 | 526 |
| ThiolTracker Violet | 405 | 526 |
| ThiolTracker Violet | 405 | 526 |
| ThiolTracker Violet | 405 | 526 |
| ThiolTracker Violet | 405 | 526 |
| Acridine Orange (+DNA) | 500 | 526 |
| ThiolTracker Violet | 405 | 526 |
| SYTO RNASelect | 503 | 527 |
| EYFP | 514 | 527 |
| SYTO RNASelect | 503 | 527 |
| SYTO RNASelect | 503 | 527 |
| SYTO RNASelect | 503 | 527 |
| SYTO RNASelect | 503 | 527 |
| Rhodamine 123 | 507 | 529 |
| YFP | 512 | 529 |
| F2N12S | 405 | 530, 585 |
| F2N12S | 405 | 530, 585 |
| F2N12S | 405 | 530, 585 |
| F2N12S | 405 | 530, 585 |
| Calcein | 494 | 540 |
| Calcium Green-1 | 506 | 540 |
| Catskill Green 540 | 482 | 540 |
| CellTracker Green | 490 | 540 |
| CFDA | 494 | 540 |
| CFP | 434 | 540 |
| Cy2 | 492 | 540 |
| CyQUANT Direct (CyQUANT GR) | 500 | 540 |
| DAF-FM | 493 | 540 |
| Emerald Green | 490 | 540 |
| Fluo-3 | 506 | 540 |
| Fluo-4 | 494 | 540 |
| H2DCFDA (H2-DCF,DCFR) | 504 | 540 |
| Alexa Fluor 430 | 434 | 540 |
| Alexa Fluor 430 | 432 | 540 |
| BCECF (pH 5.2) | 499 | 540 |
| Calcein | 494 | 540 |
| CellTracker Green CMFDA | 490 | 540 |
| CFP | 434 | 540 |
| Cy2 | 492 | 540 |
| CyQUANT Direct | 500 | 540 |
| DAF-FM | 493 | 540 |
| Fluo-4 | 494 | 540 |
| Alexa Fluor 430 | 432 | 540 |
| BCECF (pH 5.2) | 499 | 540 |
| Calcein | 494 | 540 |
| CellTracker Green CMFDA | 490 | 540 |
| CFP | 434 | 540 |
| Cy2 | 492 | 540 |
| CyQUANT Direct | 500 | 540 |
| Alexa Fluor 430 | 432 | 540 |
| BCECF (pH 5.2) | 499 | 540 |
| Pacific Orange | 440 | 551 |
| Pacific Orange | 440 | 551 |
| Pacific Orange | 440 | 551 |
| Pacific Orange | 440 | 551 |
| Pacific Orange | 440 | 551 |
| Pacific Orange | 440 | 551 |
| mBanana | 540 | 553 |
| ER-Tracker Blue-White DPX | 371 | 554 |
| Alexa Fluor 532 | 532 | 554 |
| FocalCheck Double Orange | 540 | 555 |
| HEX | 533 | 558 |
| Fluospheres Orange | 539 | 560 |
| mHoneydew | 478 | 561 |
| Vybrant DyeCycle Orange | 518 | 562 |
| ActinRed 555 (rhodamin pphalloidin) | 540 | 565 |
| Alexa Fluor 555 | 555 | 565 |
| CellRox Orange | 545 | 565 |
| Qdot 565 | UV | 565 |
| Qdot 565 | UV | 565 |
| DiI (CellTracker DiI) | 551 | 568 |
| mOrange | 548 | 568 |
| OFP | 546 | 568 |
| Bodipy TMR | 544 | 569 |
| Cy3 | 552 | 570 |
| PO-PRO-3 | 539 | 570 |
| SYTOX Orange | 567 | 570 |
| CellMask Orange | 556 | 571 |
| Alexa Fluor 546 | 561 | 572 |
| POPO-3 | 532 | 573 |
| TurboRFP | 553 | 574 |
| Calcium Orange | 549 | 575 |
| CellTracker Orange | 547 | 575 |
| Qdot 585 | UV | 585 |
| DsRed Monomer | 556 | 586 |
| pHrodo Red | 559 | 586 |
| Carboxy SNARF-1 | 548 | 587 |
| pHrodo Red | 559 | 587 |
| SpectrumOrange | 559 | 588 |
| DsRed2 | 563 | 588 |
| DiA | 456 | 590 |
| DiA | 456 | 590 |
| DiA | 456 | 590 |
| DiA | 456 | 590 |
| DiA | 456 | 590 |
| DiA | 456 | 590 |
| DiA | 456 | 590 |
| rhodamine Red-X | 572 | 591 |
| CellTrace calcein red-orange | 575 | 592 |
| LysoTracker Red | 573 | 592 |
| Sulforhodamine 101 | 578 | 593 |
| sulforhodamine 101 | 577 | 593 |
| ROX (6-ROX) | 568 | 595 |
| 2-dodecylresorufin | 582 | 595 |
| Cy3.5 | 579 | 597 |
| Cy 3.5 | 581 | 597 |
| MitoTracker Red CMXRos | 578 | 597 |
| BOBO-3 | 570 | 602 |
| Ethidium Bromide | 521 | 602 |
| X-rhod-1 | 579 | 602 |
| BOBO-1 | 570 | 602 |
| BOBO-1 | 570 | 602 |
| BOBO-1 | 570 | 602 |
| 5-ROX | 577 | 603 |
| Alexa Fluor 568 | 578 | 603 |
| Qdot 605 | UV | 605 |
| Qdot 625 | UV | 625 |
| Qdot 625 | UV | 625 |
| FM 1-43 | 510 | 626 |
| FM 1-43 | 510 | 626 |
| FM 1-43 | 510 | 626 |
| FM 1-43 | 510 | 626 |
| FM 1-43 | 510 | 626 |
| FM 1-43 | 510 | 626 |
| FM 1-43 | 510 | 626 |
| FM 1-43 | 510 | 626 |
| YO-PRO-3 | 612 | 628 |
| Alexa Fluor 610 | 610 | 629 |
| Magic Red | 570 | 630 |
| CTC Formazan | 450 | 630 |
| CTC Formazan | 450 | 630 |
| YOYO-3 | 612 | 631 |
| Katushka (Turbo FP635) | 588 | 635 |
| mKate | 588 | 635 |
| SYTO 17 | 620 | 635 |
| Di-8 ANEPPS | 468 | 635 |
| Di-8 ANEPPS | 468 | 635 |

| Dye | Peak Abs. | Peak Em. |
|---|---|---|
| Di-8-ANEPPS | 465 | 635 |
| Di-8-ANEPPS | 465 | 635 |
| Di-8-ANEPPS | 465 | 635 |
| Di-8-ANEPPS | 465 | 635 |
| Di-8-ANEPPS | 465 | 635 |
| Di-8-ANEPPS | 465 | 635 |
| Di-8-ANEPPS | 465 | 635 |
| Nile Red | 551 | 636 |
| Nile red (triglyceride) | 552 | 636 |
| Nile red (triglyceride) | 552 | 636 |
| Nile red (triglyceride) | 552 | 636 |
| Fura Red (high Ca2+) | 436 | 637 |
| Nile Red phospholipid | 551 | 638 |
| DDAO | 648 | 658 |
| DyLight 633 | 638 | 658 |
| SYTOX Red | 640 | 658 |
| ATTO 635 | 635 | 658 |
| APC (Allophycocyanin) | 651 | 660 |
| MitoTracker Deep Red FM | 641 | 661 |
| NucRed Dead 647 | 642 | 661 |
| TOTO-3 | 642 | 661 |
| BODIPY 650/665 | 647 | 665 |
| CellRox Deep Red | 640 | 665 |
| LIVE/DEAD Fixable Far Red | 650 | 665 |
| Cy5 | 648 | 666 |
| Lysotracker Deep Red | 647 | 668 |
| Alexa Fluor 647 | 650 | 670 |
| Click-iT Alexa Fluor 647 | 650 | 670 |
| DiD (Vybrant DiD) | 645 | 670 |
| HCS CellMask Deep Red stain | 649 | 670 |
| ATTO 647 | 644 | 670 |
| Fura Red (−Ca2+) | 473 | 670 |
| Fura Red (−Ca2+) | 473 | 670 |
| Fura Red (−Ca2+) | 473 | 670 |
| Fura Red (−Ca2+) | 473 | 670 |
| Fura Red (−Ca2+) | 473 | 670 |
| DyLight 649 | 654 | 673 |
| Carboxynaphthofluorescein | 600 | 674 |
| PerCP | 488 | 675 |
| CellMask Deep Red plasma membrane stain | 658 | 676 |
| DRAQ5 | 650 | 680 |
| SYTO 60 | 649 | 681 |
| SYTO 62 | 650 | 681 |
| SYTO 60 | 650 | 681 |
| FM 4-64 | 558 | 734 |
| Cy7 | 745 | 766 |
| LIVE/DEAD Fixable near-IR | 750 | 775 |
| CellVue NIR780 | 743 | 776 |
| DyLight 750 | 752 | 778 |
| IRDye 800CW | 774 | 789 |
| XenoLight CF770 | 770 | 797 |
| Qdot 800 | UV | 800 |
| Qdot 800 | UV | 800 |
| Indocyanine Green | 768 | 807 |
| Y66H | 360 | 442 |
| ABQ | 344 | 445 |
| BFP | 382 | 448 |
| BFP | 382 | 448 |
| 7-hydroxy-4-methylcoumarin | 360 | 449 |
| SpectrumBlue | 405 | 449 |
| DiFMU (pH 9.0) | 357 | 450 |
| sgBFP (Super Glow BFP) | 387 | 450 |
| SpectrumBlue | 400 | 450 |
| CellTrace Calcein Violet | 401 | 451 |
| DAPI | 345 | 455 |
| NucBlue Fixed Cell Stain | 345 | 455 |
| Pacific Blue | 405 | 455 |
| Pacific Blue | 410 | 455 |
| PO-PRO-1 | 435 | 455 |
| PO-PRO-1 | 435 | 455 |
| POPO-1 | 434 | 456 |
| POPO-1 | 434 | 456 |
| TagBFP | 402 | 457 |
| Marina Blue | 365 | 460 |
| SITS | 365 | 460 |
| Thioflavin TCN | 350 | 460 |
| Monochlorobimane (mBCI) | 380 | 461 |
| Quinine Sulfate | 349 | 461 |
| Acridine | 362 | 462 |
| CellLights CFP | 434 | 477 |
| ECFP | 434 | 477 |
| CFP | 434 | 477 |
| 1,8-ANS | 372 | 480 |
| SYTOX Blue | 444 | 480 |
| SYTOX Blue | 444 | 480 |
| Hoechst 33342 | 347 | 483 |
| NucBlue Live Cell Stain | 347 | 483 |
| CellEvent Caspase-3/7 Green | 488 | 507 |
| Diversa Green-FP | 484 | 507 |
| GFP (EGFP) | 488 | 507 |
| S65C | 479 | 507 |
| YO-PRO-1 | 491 | 507 |
| GFP | 488 | 507 |
| YO-PRO-1 | 491 | 507 |
| GFP | 488 | 507 |
| YO-PRO-1 | 491 | 507 |
| GFP | 488 | 507 |
| YO-PRO-1 | 491 | 507 |
| Premo FUCCI Cell Cycle Sensor (S/G2/M phases) | 474 | 509 |
| sgGFP (Super Glow GFP) | 474 | 509 |
| wtGFP (wild type GFP, non-UV excitation) | 475 | 509 |
| YOYO-1 | 491 | 509 |
| YOYO-1 | 491 | 509 |
| YOYO-1 | 491 | 509 |
| YOYO-1 | 491 | 509 |
| HPTS (Solvent Green 7) | 455 | 510 |
| Nitrobenzoxadiazole | 465 | 510 |
| 565L | 484 | 510 |
| LysoTracker Green | 504 | 511 |
| 565T | 488 | 511 |
| LysoTracker Green | 504 | 511 |
| LysoTracker Green | 504 | 511 |
| MitoTracker Green FM | 490 | 512 |
| MitoTracker Green FM | 490 | 512 |
| MitoTracker Green FM | 490 | 512 |
| MitoTracker Green FM | 490 | 512 |
| FluoSpheres Yellow-Green | 501 | 513 |
| Evans Blue | 460 | 515 |
| SYTO 16 | 490 | 520 |
| FITC | 492 | 520 |
| Rhodamine 110 | 496 | 520 |
| SYTO 16 | 490 | 520 |
| SYBR Green I | 497 | 521 |
| SYBR Green I | 497 | 521 |
| SYBR Green I | 497 | 521 |
| SYBR Green I | 497 | 521 |
| SYBR Green I | 497 | 521 |
| Quant-iT PicoGreen | 502 | 522 |
| Spectru mgreen | 498 | 522 |
| NucGreen Dead Cell Stain | 504 | 523 |
| Rhodamine Green | 497 | 523 |
| Rhodol Green | 496 | 523 |
| SYTOX Green | 504 | 523 |
| Rhodamine Green | 497 | 523 |
| Rhodamine Green | 497 | 523 |
| Rhodamine Green | 497 | 523 |
| Neurotrace 500/525 Green | 497 | 524 |
| Oregon Green 488 | 498 | 524 |
| SYBR Safe | 507 | 524 |
| NeuroTrace 500/525 Nissl stain | 497 | 524 |
| Oregon Green 488 | 498 | 524 |
| NeuroTrace 500/525 Nissl stain | 497 | 524 |
| Oregon Green 488 | 498 | 524 |
| NeuroTrace 500/525 Nissl stain | 497 | 524 |
| NeuroTrace 500/525 | 497 | 524 |

| Dye | Peak Abs. | Peak Em. |
|---|---|---|
| Nissl stain | | |
| Oregon Green 488 | 498 | 524 |
| Dansyl | 335 | 525 |
| Fluoro-Jade B | 480 | 525 |
| F2N12S | 405 | 530, 585 |
| F2N12S | 405 | 530, 585 |
| F2N12S | 405 | 530, 585 |
| Magnesium Green | 506 | 530 |
| NBD Amine | 450 | 530 |
| TO-PRO-1 | 515 | 530 |
| TOTO-1 | 513 | 531 |
| Oregon Green 514 | 512 | 532 |
| Sodium Green | 506 | 532 |
| Vybrant DyeCycle Green | 505 | 532 |
| pHrodo Green | 509 | 533 |
| NBD-X | 467 | 538 |
| NBD-X | 467 | 538 |
| NBD-X | 467 | 538 |
| NBD-X | 467 | 538 |
| NBD-X | 467 | 538 |
| NBD-X | 467 | 538 |
| NBD-X | 467 | 538 |
| SYBR Gold | 495 | 539 |
| SYBR Gold | 495 | 539 |
| SYBR Gold | 495 | 539 |
| SYBR Gold | 495 | 539 |
| SYBR Gold | 495 | 539 |
| Alexa Fluor 430 | 432 | 540 |
| Auramine | 460 | 540 |
| Aurophosphine | 470 | 540 |
| BCECF | 499 | 540 |
| BODIPY 492/515 | 490 | 540 |
| BODIPY 505/515 | 502 | 540 |
| BODIPY FL | 502 | 540 |
| BTC | 464 | 540 |
| CFP | 434 | 540 |
| Cy2 | 492 | 540 |
| Alexa Fluor 430 | 432 | 540 |
| BCECF (pH 5.2) | 499 | 540 |
| Alexa Fluor 430 | 432 | 540 |
| BCECF (pH 5.2) | 499 | 540 |
| Alexa Fluor 430 | 432 | 540 |
| BCECF (pH 5.2) | 499 | 540 |
| Calcein | 494 | 540 |
| CellTracker Green CMFDA | 490 | 540 |
| CFP | 434 | 540 |
| Cy2 | 492 | 540 |
| CyQUANT Direct | 500 | 540 |
| DAF-FM | 493 | 540 |
| Fluo-4 | 494 | 540 |
| TET | 520 | 541 |
| TET | 521 | 542 |
| Lucifer Yellow | 423 | 543 |
| Qdot 545 | UV | 543 |
| Lucifer Yellow | 423 | 543 |
| Lucifer Yellow | 423 | 543 |
| Lucifer Yellow | 423 | 543 |
| Lucifer Yellow | 423 | 543 |
| Lucifer Yellow | 423 | 543 |
| Lucifer Yellow | 423 | 543 |
| Lucifer yellow | 428 | 544 |
| Lucifer Yellow | 428 | 544 |
| Lucifer yellow | 428 | 544 |
| Eosin | 524 | 545 |
| JOJO-1 | 529 | 545 |
| Qdot 545 | UV | 545 |
| Qdot 545 | UV | 545 |
| Auramine O | 460 | 550 |
| LIVE/DEAD Fixable Yellow | 405 | 575 |
| LIVE/DEAD Fixable Yellow | 405 | 575 |
| LIVE/DEAD Fixable Yellow | 405 | 575 |
| LIVE/DEAD Fixable Yellow | 405 | 575 |
| LIVE/DEAD Fixable Yellow | 405 | 575 |
| LIVE/DEAD Fixable Yellow | 405 | 575 |
| DyLight 594 | 562 | 576 |
| MitoTracker Orange CMTMRos (MitoTracker Orange CM-H2TMRos) | 551 | 576 |
| Phycoerythrin (PE, R-phycoerythrin) | 567 | 576 |
| Rhod-2 | 551 | 576 |
| Rhodamine Phalloidin | 557 | 576 |
| X-Rhod-1 | 570 | 576 |
| DsRed-Express | 557 | 579 |
| Rhodamine Red | 560 | 580 |
| TAMRA | 565 | 580 |
| Tetramethylrhodamine (TRITC) | 555 | 580 |
| dTomato | 554 | 581 |
| DsRed2 | 563 | 582 |
| Amplex Ultra Red | 567 | 582 |
| Amplex Red | 571 | 583 |
| Amplex UltraRed | 568 | 583 |
| Amplex Red | 570 | 583 |
| Premo FUCCI Cell Cycle Sensor (G1 phase) | 555 | 584 |
| TagRFP | 555 | 584 |
| CellLights RFP | 552 | 585 |
| mTangerine | 568 | 585 |
| Resorufin | 570 | 585 |
| RFP | 552 | 585 |
| Qdot 585 | UV | 585 |
| Qdot 605 | UV | 605 |
| BOBO-3 | 571 | 606 |
| Calcium Crimson | 589 | 608 |
| Fluospheres Red microspheres | 577 | 608 |
| ReAsH (TC-ReAsH) | 593 | 608 |
| CellTracker Red | 585 | 612 |
| LIVE/DEAD Fixable Red | 593 | 613 |
| CellTracker Red CMTPX | 584 | 613 |
| LIVE/DEAD Fixable Red Dead Cell stain | 595 | 613 |
| DiA (FAST DiA) | 491 | 613 |
| DiA | 491 | 613 |
| HCS CellMask Red stain | 587 | 614 |
| HCS LipidTox Red | 582 | 615 |
| HCS LipidTOX Red | 582 | 615 |
| mCherry | 587 | 615 |
| Texas Red | 592 | 615 |
| Ethidium Homodimer-1 (EthD-1) | 530 | 618 |
| Propidium Iodide (PI) | 530 | 618 |
| Alexa Fluor 594 | 590 | 618 |
| Click-iT Alexa Fluor 594 | 590 | 618 |
| DyLight 594 | 593 | 618 |
| SYPRO Ruby | 450 | 618 |
| SYPRO Ruby | 450 | 618 |
| SYPRO Ruby | 450 | 618 |
| SYPRO Ruby | 450 | 618 |
| SYPRO Ruby | 450 | 618 |
| SYPRO Ruby | 450 | 618 |
| Bodipy TR-X | 588 | 621 |
| CellTrace BODIPY TR methyl ester | 597 | 625 |
| mRaspberry | 598 | 625 |
| SYTO 17 | 619 | 638 |
| Bodipy 630/650-X | 625 | 641 |
| BODIPY 630/650X | 626 | 641 |
| 7-AAD | 549 | 644 |
| HCS NuclearMask Red | 624 | 644 |
| HCS NuclearMask Red | 622 | 644 |
| SYTO 59 | 621 | 644 |
| SYTO 59 | 622 | 645 |
| Fluospheres Crimson microspheres | 620 | 646 |

| Dye | Peak Abs. | Peak Em. |
| --- | --- | --- |
| FluoSpheres crimson microspheres | 621 | 646 |
| SYTOX AADvanced dead cell stain | 546 | 647 |
| Alexa Fluor 635 | 634 | 647 |
| HcRed | 594 | 649 |
| mPlum | 590 | 649 |
| SYTO 61 | 619 | 649 |
| Alexa Fluor 633 | 631 | 650 |
| Acridine Orange + RNA | 460 | 650 |
| Acridine Orange + RNA | 460 | 650 |
| Acridine Orange(+RNA) | 460 | 650 |
| Acridine Orange(+RNA) | 460 | 650 |
| HCS LipidTOX Deep Red | 634 | 652 |
| Fura Red ( +Ca2+) | 436 | 655 |
| Fura Red ( +Ca2+) | 436 | 655 |
| Fura Red ( +Ca2+) | 436 | 655 |
| Fura Red ( +Ca2+) | 436 | 655 |
| Qdot 655 | UV | 655 |
| Fura Red (+Ca2+) | 436 | 655 |
| Fura Red (+Ca2+) | 436 | 655 |
| Qdot 655 | UV | 655 |
| FxCycle Far Red | 641 | 657 |
| TO-PRO-3 | 642 | 657 |
| FluoSpheres dark red microspheres | 657 | 683 |
| ATTO 655 | 663 | 683 |
| FluoSpheres Dark Red fluorescent microspheres | 656 | 683 |
| NucRed Live 647 | 638 | 686 |
| Vybrant DyeCycle Ruby | 638 | 686 |
| HCS NuclearMask Deep Red | 635 | 687 |
| Cy5.5 | 672 | 690 |
| Alexa Fluor 660 | 663 | 691 |
| Alexa Fluor 660 | 663 | 691 |
| Cy5.5 | 678 | 696 |
| DY-675 | 675 | 699 |
| IRDye 700 Phosphoramidite | 691 | 699 |
| ATTO 680 | 680 | 700 |
| Alexa Fluor 680 | 679 | 702 |
| HiLyte Fluor 680 | 688 | 702 |
| Qdot 705 Nanocrystals | 300 | 702 |
| Alexa Fluor 680 | 679 | 704 |
| DyLight 680 | 676 | 705 |
| Qdot 705 | UV | 705 |
| Qdot 705 | UV | 705 |
| Quasa 705 | 688 | 706 |
| IRDye 680 NHS Ester | 683 | 710 |
| RH 795 | 530 | 712 |
| RH 795 | 530 | 712 |
| RH 795 | 530 | 712 |
| RH 795 | 530 | 712 |
| RH 795 | 530 | 712 |
| Alexa Fluor 700 | 696 | 719 |
| ATTO 700 | 699 | 719 |
| FM 4-64 | 558 | 734 |
| FM 4-64 | 558 | 734 |
| FM 4-64 | 558 | 734 |

Table 14. Exemplary fluorescent reporter molecules with peak absorbance (Abs.) and emission (Em.) wavelengths specific (in nanometers).

In some other aspects, the conjugate compounds include a chemiluminescent compound, colloidal metal, luminescent compound, enzyme, radioisotope, or paramagnetic labels.

In certain aspects, the conjugates of the present disclosure are conjugated to radioactive isotopes instead of or in addition to other types of detectable agents. Certain isotopes suitable for use in the present compounds include, but not limited to, iodine-131, iodine-125, bismuth-212, bismuth-213, lutetium-177, rhenium-186, rhenium-188, yttrium-90, astatine-211, phosphorus-32 and/or samarium-153. In some aspects, the conjugates of the present disclosure contain one or more atoms having an atomic mass or mass number different from the atomic mass or mass number usually found in nature, including but not limited to, hydrogen, carbon, fluorine, phosphorous, copper, gallium, yttrium, technetium, indium, iodine, rhenium, thallium, bismuth, astatine, samarium, and lutetium (for example, $^{3}H$, $^{3}H$, $^{3}C$, $^{14}C$, $^{18}F$, $^{32}P$, $^{35}S$, $^{64}Cu$, $^{67}Ga$, $^{90}Y$, $^{99M}Tc$, $^{111}In$, $^{125}I$, $^{123}I$, $^{131}I$, $^{135}I$, $^{186}Re$, $^{187}Re$, $^{201}Tl$, $^{212}Bi$, $^{211}At$, $^{53}Sm$ and/or $^{177}Lu$). In other aspects, the conjugates of the present disclosure are labeled with a paramagnetic metal ion that is a good contrast enhancer in Magnetic Resonance Imaging (MRI). Examples of such paramagnetic metal ions include, but are not limited to, gadolinium III (Gd3+), chromium 111 (Cr3+), dysprosium III (Dy3+), iron 111 (Fe3+), manganese II (Mn2+), and ytterbium III (Yb3+). In certain embodiments, the labeling moieties comprises gadolinium III (Gd3+).

In some aspects, the conjugates of the present disclosure are conjugated to biotin. In addition of extension of half-life, biotin also acts as an affinity handle for retrieval of the peptides from tissues or other locations. In one aspect, the conjugates are conjugated, e.g., to a biotinidase resistant biotin with a PEG linker (e.g., NHS-dPEG4-Biotinidase resistant biotin). In some aspects, fluorescent biotin conjugates that can act both as a detectable label and an affinity handle are used. Non-limiting examples of commercially available fluorescent biotin conjugates include Atto 425-Biotin, Atto 488-Biotin, Atto 520-Biotin, Atto-550 Biotin, Atto 565-Biotin, Atto 590-Biotin, Atto 610-Biotin, Atto 620-Biotin, Atto 655-Biotin, Atto 680-Biotin, Atto 700-Biotin, Atto 725-Biotin, Atto 740-Biotin, fluorescein biotin, biotin-4-fluorescein, biotin-(5-fluorescein) conjugate, and biotin-B-phycoerythrin, alexa fluor 488 biocytin, alexa flour 546, alexa fluor 549, lucifer yellow cadaverine biotin-X, Lucifer yellow biocytin, Oregon green 488 biocytin, biotin-rhodamine and tetramethylrhodamine biocytin.

Linkers. In some aspects, the peptides of the present disclosure are directly conjugated to a detectable label, such as a dye, fluorescent moiety or the like such that no additional amino acids, carbohydrates, nucleic acids, polymers, organic chains, or the like are added to the chlorotoxin or chlorotoxin variant and/or the dye, fluorescent moiety or the like to comprise the chlorotoxin conjugates described herein. In some other aspects, a linker is used to conjugate the chlorotoxin or chlorotoxin variant is not directly conjugated to a dye, fluorescent moiety or the like such that additional amino acids, carbohydrates, nucleic acids or the like are added to the chlorotoxin or chlorotoxin variant and/or the dye, fluorescent moiety or the like to comprise the chlorotoxin conjugates described herein. A "linker" as used herein refers to at least one compound comprising two functional groups that are capable of reacting specifically with other moieties to form covalent or non-covalent linkages. Such moieties include, but are not limited to, the side groups on natural or non-natural amino acids or peptides which contain such natural or non-natural amino acids. By way of example, a linker has a functional group reactive with a group on a first peptide, and another functional group which is reactive with a group on a second peptide, whereby forming a conjugate that includes the first peptide, the linker and the second peptide. Many procedures and linker molecules for attachment of various compounds to peptides are known. See, e.g., European Patent Application No. 188,256; U.S. Pat. Nos. 4,671,958, 4,659,839, 4,414,148, 4,699,784; 4,680,338; and 4,569,789 which are incorporated by reference herein in their entirety.

The term "linkage," as used herein refers to a bond or a chemical moiety formed from a chemical reaction between the functional group of a linker and another molecule. Such bonds include, but are not limited to, covalent linkages and non-covalent bonds, while such chemical moieties include, but are not limited to, esters, carbonates, imines phosphate esters, hydrazones, acetals, orthoesters, peptide linkages, and oligonucleotide linkages. Hydrolytically stable linkages means that the linkages are substantially stable in water and do not react with water at neutral pH values, including but not limited to, under physiological conditions for an extended period of time, perhaps even indefinitely. Hydrolytically unstable or degradable linkages mean that the linkages are degradable in water or in aqueous solutions, including for example, blood. Enzymatically unstable or degradable linkages mean that the linkage is often degraded by one or more enzymes. By way of example, PEG and related polymers include degradable linkages in the polymer backbone or in the linker group between the polymer backbone and one or more of the terminal functional groups of the polymer molecule. Such degradable linkages include, but are not limited to, ester linkages formed by the reaction of PEG carboxylic acids or activated PEG carboxylic acids with alcohol groups on a biologically active agent, wherein such ester groups generally hydrolyze under physiological conditions to release the biologically active agent. Other hydrolytically degradable linkages include but are not limited to carbonate linkages; imine linkages resulted from reaction of an amine and an aldehyde; phosphate ester linkages formed by reacting an alcohol with a phosphate group; hydrazone linkages which are reaction product of a hydrazide and an aldehyde; acetal linkages that are the reaction product of an aldehyde and an alcohol; orthoester linkages that are the reaction product of a formate and an alcohol; peptide linkages formed by an amine group, including but not limited to, at an end of a polymer such as PEG, and a carboxyl group of a peptide; and oligonucleotide linkages formed by a phosphoramidite group, including but not limited to, at the end of a polymer, and a 5' hydroxyl group of an oligonucleotide.

The conjugates for use in the method described herein is conjugated by using any art-recognized method forming a complex including covalent, ionic, or hydrogen bonding of the ligand to the imaging agent, either directly or indirectly via a linking group such as a linker. The conjugate is typically formed by covalent bonding of the ligand to the imaging agent through the formation of amide, ester or imino bonds between acid, aldehyde, hydroxy, amino, or hydrazo groups on the respective components of the complex or, for example, by the formation of disulfide bonds.

In addition, structural modifications of a linker portion of the conjugates are contemplated herein. For example, a number of amino acid substitutions are often made to the linker portion of the conjugate, including but not limited to naturally occurring amino acids, as well as those available from conventional synthetic methods. In one aspect, beta, gamma, and longer chain amino acids are used in place of one or more alpha amino acids. In another aspect, the stereochemistry of the chiral centers found in such molecules is selected to form various mixture of optical purity of the entire molecule, or only of a subset of the chiral centers present. In another aspect, the length of the peptide chain included in the linker is shortened or lengthened, either by changing the number of amino acids included therein, or by including more or fewer beta, gamma, or longer chain amino acids. In another aspect, the selection of amino acid side chains in the peptide portion is made to increase or decrease the relative hydrophilicity of the linker portion specifically or of the overall molecule generally.

Similarly, the length and shape of other chemical fragments of the linkers described herein is often modified. In some aspects, the linker includes an alkylene chain. The alkylene chain often varies in length, or includes branched groups, or includes a cyclic portion, which are in line or spiro relative to the allylene chain. In another aspect, where the linker includes a beta thiol releasable fragment, it is appreciated that other intervening groups connecting the thiol end to the hydroxy or carbonate end are used in place of the ethylene bridge, such as but not limited to optionally substituted benzyl groups, where the hydroxy end is connected at the benzyl carbon and the thiol end is connected through the ortho or para phenyl position, and vice versa.

Formulations of Chlorotoxin Conjugates

In various aspects, the present disclosure provides compositions comprising the above-described compounds and a pharmaceutically acceptable carrier. In some aspects, the composition is formulated for parenteral administration. In further aspects, the composition is formulated for intravenous administration, intramuscular administration, subcutaneous administration, or a combination thereof.

Certain methods described herein comprise administering to the subject an intravenous pharmaceutical composition comprising a chlorotoxin conjugate, for example, as described herein. Intravenous pharmaceutical compositions of chlorotoxin conjugates include any formulation suitable for administration to a subject via any intravenous method, including a bolus, an infusion which occurs over time or any other intravenous method known in the art. In some aspects, the rate of infusion is such that the dose is administered over a period of less than five minutes, more than five minutes but less than 15 minutes or greater than 15 minutes. In other aspects, the rate of infusion is such that the dose is administered over a period of less than 5 minutes. In other aspects, the rate of infusion is such that the dose is administered over a period of greater than 5 minutes and less than 15 minutes. In some other aspects, the rate of infusion is such that the dose is administered over a period of greater than 15 minutes.

"Product" or "dosage form" as used herein refers to any solid, semi-solid, lyophilized, aqueous, liquid or frozen formulation or preparation used for administration. Upon administration, the rate of release of an active moiety from a product is often greatly influenced by the excipients and/or product characteristics which make up the product itself. For example, an enteric coat on a tablet is designed to separate that tablet's contents from the stomach contents to prevent, for example, degradation of the stomach which often induces gastrointestinal discomfort or injury. According to the currently accepted conventional understanding, systemic exposure of the active moiety will be relatively insensitive to the small formulation changes.

As used herein "pharmaceutically acceptable" or "pharmacologically acceptable" includes molecular entities and compositions that do not produce an adverse, allergic or other untoward reaction when administered to a subject, as appropriate. "Pharmaceutically acceptable carrier" includes any and all solvents, dispersion media, coatings, antibacterial and antifungal agents, isotonic and absorption delaying agents and the like. The use of such media and agents for pharmaceutical active substances is well known in the art. Except insofar as any conventional media or agent is incompatible with the active ingredient, its use in the therapeutic compositions is contemplated. Supplementary active ingredients are often also incorporated into the compositions.

In various aspects, the present compositions comprise a concentration of the compound as an active pharmaceutical ingredient having a concentration of from 1 mg/mL to 40 mg/mL. In further aspects, the concentration of the compound is from 1 mg/mL to 20 mg/mL. In still other aspects, the concentration of the compound is from 4 mg/mL to 10 mg/mL. In additional aspects, the concentration of the compound is from 5 mg/mL to 8 mg/mL. In yet further aspects, concentration of the compound is from 5 mg/mL to 6 mg/mL.

In some aspects, pharmaceutically acceptable carrier comprises tris, D-mannitol, and a pH of essentially 6.8. In other aspects, the compositions consist essentially of tris, D-mannitol, and a pH of 6.8.

In some aspects, pharmaceutically acceptable carrier comprises histidine and mannitol. In some aspects, pharmaceutically acceptable carrier comprises histidine and mannitol with polysorbate 20. In some aspects, pharmaceutically acceptable carrier comprises L-histidine, D-mannitol, L-methionine, and a pH of essentially 6.8. In additional aspects, the pharmaceutically acceptable carrier consists essentially of L-histidine, D-mannitol, L-methionine, and a pH of 6.8.

In some aspects, the pharmaceutically acceptable carrier comprises L-histidine, D-mannitol, polysorbate 20, and a pH of essentially 6.8. In some aspects, the pharmaceutically acceptable carrier comprises L-histidine, D-mannitol, and a pH of essentially 6.8. In some aspects, the pharmaceutically acceptable carrier comprises L-histidine, D-mannitol, polysorbate 20, trehalose, and a pH of essentially 6.8.

A pharmaceutical composition comprising a chlorotoxin conjugate is formulated according to known methods to prepare pharmaceutically useful compositions, for example, as found in "Excipient Selection in Parenteral Formulation Development" Pramanick et. al., Pharma Times, Vol. 45., No. 3, March 2013, incorporated in its entirety herein by reference. In some aspects, the chlorotoxin conjugate is combined with a pharmaceutically acceptable carrier. A composition is said to be a pharmaceutically acceptable carrier if its administration is tolerated by a recipient patient. Sterile phosphate-buffered saline is one example of a pharmaceutically acceptable carrier. Other suitable carriers are well-known to those in the art. See, for example, Gennaro (ed.), Remington's Pharmaceutical Sciences, 19th Edition (Mack Publishing Company 1995).

Formulations for administration of chlorotoxin conjugates are typically provided but are not limited to as liquid, solid or semi-solid products or dosage forms, exemplified by tablets, capsules, pellets, a powder or a lyophilized product. In some aspects, the chlorotoxin conjugate is formulated to comprise no additional materials except for a pharmaceutical carrier. In some other aspects, the chlorotoxin conjugate is formulated such that it comprises a core "matrix material" which encapsulates, binds to, coats or is adjacent to the chlorotoxin conjugate. In some other aspects, the chlorotoxin conjugate and matrix material further comprises a protective coatings. Various formulations are well-known to those in the art. See, for example, Gennaro (ed.), Remington's Pharmaceutical Sciences, 19th Edition (Mack Publishing Company 1995).

Suitable excipients for use with chlorotoxin conjugates are often included in formulations for intravenous use, for example, an injection. Injections are sterile, pyrogen-free solutions or dispersions (emulsions or suspensions) of one or more active ingredients in a suitable vehicle or carrier. Injections that are dispersions should remain sufficiently stable so that, after shaking, a homogeneous dose is withdrawn. More specifically, formulations which include chlorotoxin conjugates and one or more but not limited to suitable excipients, exemplified by matrix materials, binders, lubricants, glidants or disintegrants which aid in modulating the PK profile of administered chlorotoxin conjugates are preferred. In some aspects, compositions comprising chlorotoxin conjugates in combination with one or more suitable excipients and one or more specific product characteristics (such as dissolution or water content) which result in improved pharmacokinetic profiles of chlorotoxin conjugates in vivo. Thus, the in vivo performance of chlorotoxin conjugates dosage forms/products included herein is based upon the composition of the excipients added during manufacturing and/or the final product characteristics generated through specific processing parameters and methods. Other excipients are well-known to those in the art. See, for example, Gennaro (ed.), Remington's Pharmaceutical Sciences, 19th Edition (Mack Publishing Company 1995).

Suitable carriers for intravenous administration include for example but are not limited to physiological saline or phosphate buffered saline (PBS), Tris, and solutions containing solubilizing agents, such as glucose, polyethylene glycol, polypropylene glycol, additional agents such as histidine, dextrose, mannitol and mixtures thereof. In some aspects, carriers for intravenous administration include a mixture of histidine and dextrose, Tris and dextrose or Tris and mannitol. Other carriers are well-known to those in the art. See, for example, Gennaro (ed.), Remington's Pharmaceutical Sciences, 19th Edition (Mack Publishing Company 1995).

The formulation often includes an aqueous vehicle. Aqueous vehicles include, by way of example and without limitation, sodium chloride solution, Ringers solution, isotonic dextrose solution, sterile water solution, dextrose and lactated Ringers solution. Nonaqueous vehicles include, by way of example and without limitation, fixed oils of vegetable origin, cottonseed oil, corn oil, sesame oil and peanut oil, benzyl benzoate, castor oil, N,N-dimethylacetamide, ethanol, dehydrated ethanol, glycerin, glycerol, N-methyl-2-pyrrolidone, polyethylene glycol and any derivative thereof, propylene glycol, safflower oil and soybean oil. Other vehicles are well-known to those in the art. See, for example, Gennaro (ed.), Remington's Pharmaceutical Sciences, 19th Edition (Mack Publishing Company 1995).

In some aspects, the composition the pharmaceutically acceptable carrier comprises an osmolyte. In some aspects, the osmolyte comprises a sugar, a sugar alcohol, or a combination thereof.

In certain aspects, the composition comprises a sugar alcohol selected from sorbitol, inositol, mannitol, xylitol and glycerol, or a combination thereof. In further aspects, the sugar alcohol comprises mannitol. In certain aspects, the composition comprises from 2% to 20% (wt/vol %) mannitol. In some aspects, the composition comprises from 2% to 10% (wt/vol %) mannitol. In further aspects, the composition comprises essentially 5% (wt/vol %) mannitol.

In other aspects, the composition comprises a sugar. In certain aspects, the sugar is selected from trehalose, lactose, sucrose, glucose, galactose, maltose, mannose, fructose, dextrose, or a combination thereof. In additional aspects, the sugar is selected from trehalose, sucrose, or a combination thereof. In some aspects, the composition comprises from 1% to 40% (wt/vol %) of trehalose, sucrose, or a combination of trehalose and sucrose. In other aspects, the composition comprises from 1% to 20% (wt/vol %) of trehalose, sucrose, or a combination of trehalose and sucrose. In additional aspects, the composition comprises 2% (wt/vol %) of trehalose, sucrose, or a combination of trehalose and sucrose.

In certain aspects, the composition further comprises an osmolyte selected from glycine, carnitine, ethanolamine, their phosphates, mono sugars, or a combination thereof.

In some aspects, the present compositions are isotonic. In other aspects, the compositions are essentially isotonic.

In certain aspects, the ionic strength of the composition is less than 50 mM. In other aspects, the ionic strength of the composition is less than 10 mM.

Antimicrobial agents in bacteriostatic or fungistatic concentrations are typically added to preparations packaged in multiple dose containers which include by way of example and without limitation, phenols or cresols, mercurials, benzyl alcohol, chlorobutanol, methyl and propyl p-hydroxybenzoic acid esters, thimerosal, benzalkonium chloride and benzethonium chloride. Other antimicrobial agents are well-known to those in the art. See, for example, Gennaro (ed.), Remington's Pharmaceutical Sciences, 19th Edition (Mack Publishing Company 1995).

Buffers include by way of example and without limitation, acetate, ammonium sulfate, ammonium hydroxide, arginine, aspartic acid, benzene sulfonic acid, benzoate sodium, benzoate acid, carbonate, sodium carbonate, carbon dioxide, citrate, diethanolamine, glucono delta lactone, glycine, glycine HCl, histidine, histidine HCl, hydrochloric acid, hydrobromic acid, lysine maleic acid, meglumine, methanesulfonic acid, monoethanolamine, phosphate, sodium phosphate, citrate, succinate sodium, sulfuric acid, tartarate sodium, trimethamine, sodium citrate, hydroxide, sodium hydroxide, Tris base, Tris base -65, Tris acetate, Tris HCl, and Tris HCl-65.

In various aspects, the pharmaceutically acceptable carrier comprises a buffer. In some aspects, the buffer is selected from tris, HEPES, histidine, ethylene diamine, or a combination thereof. In other aspects, the buffer is selected from tris, histidine, or a combination thereof. In further aspects, the buffer comprises histidine, which is optionally L-histidine. In additional aspects, the composition comprises at least 100 mM histidine. In further aspects, the composition comprises at least 50 mM histidine. In some aspects, the composition comprises at least 20 mM histidine. In additional aspects, the composition comprises 10 to 100 mM histidine. In other aspects, the composition comprises 10 to 20 mM histidine.

Antioxidants include by way of example and without limitation, sodium bisulfate, acetone sodium bisulfate, argon, ascorbyl palmitate, ascorbate sodium, ascorbate acid, butylated hydroxy anisole, butylated hydroxy toluene, cysteine, cystenate HCl, dithionite sodium, gentistic acid, gentistic acid ethanoloamine, glutamate monosodium, glutathione, formaldehyde solfoxylate sodium, metabisulfite potassium, metabisulfite sodium, methionine, monothioglycerol, nitrogen, propyl gallate, sulfite sodium, tocopherol alpha, alpha tocopherol hydrogen succinate and thioglycolyate sodium.

In some aspects, the compositions comprise an antioxidant, a free radical scavenger, a quencher, an antioxidant synergist or a combination thereof.

In some aspects, the antioxidant is selected from methionine, butylated hydroxytoluene, butylated hydroxyanisole, propyl gallate, or a combination thereof. In other aspects, the antioxidant comprises methionine. In further aspects, the antioxidant is L-methionine. In certain aspects, the compositions comprise at least 20 mM methionine. In other aspects, aspects, the compositions comprise at least 10 mM methionine.

Suspending, emulsifying and/or dispersing agents include by way of example and without limitation, sodium carboxymethylcelluose, hydroxypropyl methylcellulose, Polysorbate 80 (TWEEN® 80) and polyvinylpyrrolidone.

In various aspects, the compositions comprise a surfactant. In certain aspects, the surfactant is selected from polysorbate 20, polysorbate 80, a pluronic, polyoxyethylene sorbitan mono-oleate, polyethylene mono-laureate, N-actylglucoside, or a combination thereof. In certain aspects, the surfactant is polysorbate 20. In further aspects, the compositions comprise from 0.0001% to 0.1% (wt/vol %) polysorbate 20. In additional aspects, the compositions comprise cyclodextrin. In further aspects, the cyclodextrin comprises (2-hydroxypropyl)-β-cyclodextrin.

A sequestering or chelating agent of metal ions include by way of example and without limitation, calcium disodium EDTA, disodium EDTA, sodium EDTA, calcium versetaminde sodium, calteridol and DPTA. In some aspects, the present compositions comprise a metal chelator. In certain aspects, the metal chelator is selected from EDTA, deferoxamine mesylate, EGTA, fumaric acid, and malic acid, salts thereof, or combinations thereof. In further aspects, the metal chelator comprises EDTA or salts thereof. In certain aspects, the compositions have an EDTA concentration of about 0.1 mg/ml to about 1.0 mg/ml.

Other isotonic agents, buffers, antioxidants, anesthetics, suspending and dispersing agents, emulsifying agents and chelating agents are well-known to those in the art. See, for example, Gennaro (ed.), Remington's Pharmaceutical Sciences, 19th Edition (Mack Publishing Company 1995).

Pharmaceutical carriers also include, by way of example and without limitation, ethyl alcohol, polyethylene glycol and propylene glycol for water miscible vehicles and sodium hydroxide, hydrochloric acid, citric acid or lactic acid. Other pharmaceutical carriers are well-known to those in the art. See, for example, Gennaro (ed.), Remington's Pharmaceutical Sciences, 19th Edition (Mack Publishing Company 1995).

The chlorotoxin conjugates described herein are often formulated using a variety of parameters including by way of example and without limitation, pH, molarity, % weight/volume, % volume/volume and the like. Other factors considered in the formulation of, stability of, storage of, shipping of chlorotoxin conjugates include by way of example and without limitation, the gas environment, container material, container color, cap material, cap color, presence of additional aspects, such as antioxidants, stabilizers, photoprotective compounds, protectants, sugars, ion chelators, ion donors or the like. Any factor which serves as any one of the above factors known to one of ordinary skill in the art is often used with the chlorotoxin conjugates described herein but not limited as such.

The preparation of pharmaceutical or pharmacological compositions are known to those of skill in the art in light of the present disclosure. General techniques for formulation and administration are found in "Remington: The Science and Practice of Pharmacy, Twentieth Edition," Lippincott Williams & Wilkins, Philadelphia, Pa. Tablets, capsules, pills, powders, granules, dragees, gels, slurries, ointments, solutions suppositories, injections, inhalants and aerosols are examples of such formulations.

The chlorotoxin conjugates are often stored at various temperatures, including by way of example and without limitation, freezing, for example at about −20° C., about −70° C., about −100° C., about −120° C., about −150° C., about −200° C. or more than about −200° C., cold storage, for example at about 10° C., about 5° C., about 4° C., about 2° C., about 0° C., about −2° C. or more than about −5° C., or any other suitable temperature such that the composition remains stable.

In some aspects, compositions comprising the compounds described herein are stored as lyophilized solids. In some aspects, the present disclosure provides methods for producing the lyophilized composition, the method comprising providing the composition; and lyophilizing the composition, thereby producing the lyophilized composition.

Using lyophilization, it is possible to store the compounds in a manner that maintains physiological or otherwise optimal pH, isotonicity and stability. Such materials include pH buffers, preservatives, tonicity adjusting agents, anti-oxidants, other polymers (e.g., viscosity adjusting agents or extenders) and excipients to stabilize the labile protein against the stresses of drying and storage of the dried product. Specific illustrative examples of such additives include phosphate, citrate, or borate buffers; thimerosal; sorbic acid; methyl or propyl paraben, and chlorobutanol preservatives; sodium chloride: polyvinyl alcohol, polyvinyl pyrrolidone; mannitol, dextrose, dextran, lactose, sucrose, ethylene diamine tetra-acetic acid, and the like. Suitable formulations, known in the art, (Remington's Pharmaceutical Sciences (latest edition), Mack Publishing Company, Easton, Pa.; Arakawa et al. (1990), supra; Carpenter et al. (1991), supra; and Pikal (1990), supra).

In certain aspects, the pharmaceutically acceptable carrier comprises a reconstitution stabilizer. In other aspects, the reconstitution stabilizer comprises a water-soluble polymer. In additional aspects, the water-soluble polymer is selected from a polaxamer, a polyol, a polyethylene glycol, a polyvinylalcohol, a hydroxyethyl starch, dextran, polyvinylpyrrolidene poly(acrylic acid), or a combination thereof.

The term "reconstitution stabilizer" means any excipient which is capable of preventing aggregation of a reconstituted protein in an aqueous medium. Excipients possessing the necessary characteristics for the present invention are well-known in the art and generally function by the mechanisms of charge repulsion, steric hindrance, hydrophobic binding or specific high-affinity binding to the dried protein. Exemplary excipients include various osmolytes, various salts, water soluble synthetic and natural polymers, surfactants, sulfated polysaccharides, carrier proteins, buffers and the like (Manning et al. (1989), Pharmaceutical Research, 6:903-918; and Paborji, et al. (1994), Pharmaceutical Research, 11:764-771).

The present compounds and an effective amount of the reconstitution stabilizer are admixed under conditions effective to reduce aggregation of present compounds upon reconstitution with the reconstitution medium (e.g., a solvent and optionally other components such as antibacterials). The reconstitution stabilizer may be admixed with the compounds at a suitable time before, during or after reconstitution; preferably the reconstitution stabilizer will be pre-dissolved in the reconstitution medium. The compound is reconstituted at a temperature which is above the freezing point of the reconstitution medium, but which will not degrade the compound and which will not be deleterious to the reconstitution stabilizer; preferably the temperature will be between about 2° C. to 50° C. The time taken to mix the reconstitution stabilizer and the dried compound should be for a sufficient period to prepare a suitable admixture; preferably mixing will be for between about 1 to 30 minutes. Generally, the reconstituted formulation is used soon after reconstitution.

In certain aspects, the present compositions are reconstituted from a lyophilized form. In other aspects, the present disclosure provides methods for producing the reconstituted composition, the method comprising providing a lyophilized composition; and reconstituting the composition with a solution to produce a reconstituted composition. In various aspects, the reconstituting solution comprises water. In some aspects, the reconstituting solution is selected from sterile water, physiological saline solution, glucose solution or other aqueous solvents (e.g., alcohols such as ethyl, n-propyl or isopropyl, butyl alcohol), or a combination thereof, which are capable of dissolving the dried composition and compatible with the selected administration route and which does not negatively interfere with the compound and the reconstitution stabilizers employed.

Storage Vessels

In some aspects, the chlorotoxin conjugates are placed into containers following formulation. Often the containers include by way of example and without limitation, glass, for example amber glass or colorless glass. The containers often include by way of example and without limitation, a plastic, a rubber, a metal, a biodegradable material or the like known to one of skill in the art and are any color, colorless, opaque or clear. In some aspects, the chlorotoxin conjugates are placed into containers which are sealed following formulation. Often the seal is a cap, for example, the cap is a plastic, a rubber, a metal, a biodegradable material, a combination of or the like known to one of skill in the art and are any color, colorless, opaque or clear, sometimes a film. In some aspects, a gas is included in the container, often to enhance stability of the chlorotoxin conjugate or prevent oxygen from contacting the chlorotoxin conjugate. For example, gas includes by way of example and without limitation, an inert gas, such as nitrogen or argon, occasionally a noble gas and is used at any suitable concentration.

In some aspects the compounds of the present disclosure are stored in a vessel comprising glass, particularly a Type I glass, which has been subjected to a washing or extraction treatment which reduces the level of extractable trivalent and divalent metal ions present in/on the surface of the glass. Such treatments include steeping in (extraction with) hot (preferably at least 90° C.) water or another aqueous medium, e.g. ammonium sulfate solution, or treatment with sulfur dioxide.

In some aspects, the compounds of the present disclosure are stored in a vessel comprising USP Type 1 borosilicate glass vial with a 13 mm chlorobutyl based stopper with flourotech coating on plug and B2 coating on the top and an aluminum over seal with flip top cap.

In certain aspects, the compounds of the present disclosure are stored in a foil-lined chamber. In some aspects, the chamber comprises a dry inert atmosphere, preferably nitrogen, and a desiccant or oxygen absorber.

In various aspects, the present disclosure provides a kit comprising vessel configured to contain a fluid; any of the compounds and compositions described herein; and an elastomeric closure affixed to the vessel.

In some aspects, the kit further comprises a light shield. In further aspects, the light shield is a physical barrier configured to block at least a portion of the light incident on the vessel from the composition. In still further aspects, the physical barrier comprises an opaque or semi-opaque material.

In some aspects, the vessel is a glass vial. In further aspects, the glass vial comprises clear or amber glass. In some aspects, the glass vial is an untreated glass container. In certain aspects, the glass vial comprises USP Type I, Type II, Type III, or Type IV glass. In some aspects, the inner portion of the vessel further comprises a silica ($SiO_2$) coating or silicone coating. In some aspects, the untreated glass container is selected from an ampoule, vial, ready-to-use syringe, or carpule.

In some aspects, the elastomeric closure is a halobutyl rubber closure. In further aspects, the halobutyl rubber closure is selected from a chlorobutyl rubber closure or a bromobutyl rubber closure. In some aspects, elastomeric closure is coated with Fluorotec, B2, or a combination thereof.

In some aspects, the kit further comprises an opaque secondary package surrounding the vessel. In certain aspects, the opaque secondary package comprises an opaque box, an opaque aluminum foil pouch, or a combination thereof. In further aspects, the opaque secondary package is configured to block at least 90% of the light incident on the package exterior from the composition. In still further aspects, the opaque secondary package is configured to block at least 95% of the light incident on the package exterior from the composition. In still further aspects, the opaque secondary package is configured to block at least 99% of the light incident on the package exterior from the composition. In still further aspects, the opaque secondary package is configured to block at least 99.9% of the light incident on the package exterior from the composition.

In some aspects, the vessel comprises a reduced-oxygen environment in contact with the composition. In certain aspects, the vessel comprises an inert gas in contact with the composition. In some aspects, the composition is sparged with an inert gas, thereby producing the reduced-oxygen environment in the vessel. In certain aspects, the inert gas comprises nitrogen or argon.

Dosages and Toxicity of Compounds

The product or dosage form characteristics which result from the processing methods and/or parameters for generating formulations such as powders, lyophilized compositions, and the like include, but are not limited to, density, water content, friability, disintegration, dissolution profile(s), shape, size, weight, uniformity and composition of the particles. These product characteristics are often modulated in a number of ways and affect the final in vitro and/or in vivo performance of the formulations. Product or dosage form characteristics are often a consequence of excipient selection, excipient composition, manufacturing methods applied or a combination of any of these. The combination of excipients as well as product characteristics (including processing methods or processing parameters) of the final dosage form will ultimately determine the pharmacokinetic profile of the active ingredient in vivo. The administered chlorotoxin conjugate formulations described herein are often processed or manufactured under specific conditions such as, for example, mixing methods (including sieve size, rpm, and milling), drying time, conditions, environmental parameters (e.g., temperature and humidity) and combinations thereof) which themselves modulate the pharmacokinetic profile of chlorotoxin compositions in vivo (i.e., increase the average $C_{max}$ or AUC). In order to quantitatively compare one formulation to another, it is customary to measure several of these product or dosage form characteristics. This is also necessary when attempting to duplicate multiple batches.

Dissolution and drug release from formulations depends on many factors including the solubility and concentration of the active ingredient, the nature and composition of the excipients, content uniformity, water content, product shape and size, porosity, disintegration time and other factors. The release of a drug or active ingredient from a final dosage form in vitro is typically characterized by its dissolution profile under standardized conditions (using United States Pharmacopeia (USP) or similar accepted methods for reference) and at the appropriate pH, often a neutral pH. The dissolution profile shows the amount of drug released over time into the test media under specified conditions. Standard conditions make use of buffers at an appropriate pH in order to best mimic the pH of a subject's blood.

Typically a therapeutically effective dosage is formulated to contain a dose of at least about 0.1 mg up to about 1.5 mg or more, such as more than 1.5 mg of chlorotoxin conjugate. In some aspects, the effective dosage is formulated to contain a dose of at least about 0.01 mg, about 0.02 mg, about 0.03 mg, about 0.5 mg, about 0.07 mg, about 0.1 mg, about 0.2 mg, about 0.3 mg, about 0.35 mg, about 0.375 mg, about 0.4 mg, about 0.5 mg, about 0.6 mg, about 0.7 mg, about 0.75 mg, about 0.8 mg, about 0.9 mg, about 1 mg, about 1.3 mg, about 1.4 mg, about 1.5 mg, about 1.8 mg, about 1.9 mg, about 2 mg, about 2.4 mg, about 3 mg, about 5 mg, about 6 mg, about 7 mg, about 12 mg, about 18 mg or about 60 mg more of chlorotoxin conjugate. In an exemplary aspect, the dose is 0.1 mg for a mouse, 1 mg for a dog, 0.3 mg for a rat, 0.6 mg for a monkey and 3 mg for a human. The amount of chlorotoxin conjugate administered to a subject is often the total about amount listed herein. In some aspects, the amount of chlorotoxin conjugate administered to a subject is often the about per milligram, gram or kilogram of subject weight for each amount listed herein. In other aspects, the amount of chlorotoxin conjugate administered to a subject is often the about per milliliter or liter of fluid volume for each amount listed herein. In yet other aspects, the amount of chlorotoxin conjugate administered to a subject is often the about per square millimeter, square centimeter or square meter of subject surface body area or subject body area for each amount listed herein.

As used herein a "dosage regimen" refers to the protocol used to administer an intravenous pharmaceutical formulation comprising chlorotoxin conjugate to a subject. In some aspects, the dosage regimen comprises a dose amount and dosing interval. In some aspects, the dosage regimen further comprises a dosing duration. As used herein "dosing duration" refers to the period of time over which a dose is administered.

In some aspects, the dose of chlorotoxin conjugate is administered to a subject using either a fixed or a scaling dosing scheme. For example, a fixed dosing scheme includes administration of a bolus or continuous dose of chlorotoxin conjugate to a subject via an intravenous administration route wherein the fixed dose is, for example and without limitation, about 3 mg to about 6 mg and does not account or adjust for a subject's age, weight, height, body mass index, metabolism, or the like. For example, a scaling dosing scheme includes administration of a bolus or continuous dose of chlorotoxin conjugate to a subject via an intravenous administration route wherein the scaled dose is, for example and without limitation, about 3 mg to about 6 mg and accounts or adjusts for a subject's age, weight, height, body mass index, metabolism, or the like. In some aspects, the fixed dose and/or the scaled dose are determined for one subject based upon the dose administered to a different subject wherein the subjects are or are not the same species, for example a mouse and a human or a rat and a human, or a dog and a human or a monkey and a human or a non-human primate and a human. Often in a fixed dose, the same dose or about the same dose is administered to all subjects, for example a mouse and a human or a rat and a human, or a dog and a human or a monkey and a human or a non-human primate and a human. In some aspects, the scaled dose to be administered to a subject is determined from the dose administered to a different subject wherein the subjects are or are not the same species, for example a mouse and a human or a rat and a human, or a dog and a human or a monkey and a human or a non-human primate and a human. The scaled dose is therefore increased from the dose administered to the mouse, rat, dog, monkey or non-human primate to the dose administered to the human based upon the difference between the mouse, rat, dog, monkey or non-human primate and the human on factors such as subject age, weight, height, metabolism, size or the like. In a preferred aspect, the dose is scaled from a rat to a human.

The compounds and compositions described herein are administered to a subject before surgery, during surgery and/or the excised tissue from the subject is contacted with compositions of the chlorotoxin conjugates. In some aspects, compositions of chlorotoxin conjugates are intravenously administered to a subject about 1 hour, about 2 hours, about 3 hours, about 4 hours, about 5 hours, about 6 hours, about 9 hours, about 12 hours, about 24 hours, about 36 hours, about 48 hours or about 72 hours before surgery. In some aspects, compositions of chlorotoxin conjugates are intravenously administered to a subject between 0 and 1 hours, between 1 and 2 hours, between 2 and 3 hours, between 3 and 4 hours, between 4 and 5 hours, between 5 and 6 hours, between 6 and 9 hours, between 9 and 12 hours, between 12 and 24 hours, between 24 and 36 hours, between 36 and 48 hours or between 48 and 72 hours (inclusive) before surgery. Tissue or fluid samples are often isolated from a subject prior to administration of a chlorotoxin conjugate, sometimes as a baseline reference. Samples are also isolated from a subject after administration of the compounds of the present disclosure, often less than about 1 minute after, about 2 minutes after, about 3 minutes after, about 4 minutes after, about 5 minutes after, about 6 minutes after, about 7 minutes after, about 8 minutes after, about 9 minutes after, about 10 minutes after, about 11 minutes after, about 12 minutes after, about 13 minutes after, about 14 minutes after, about 15 minutes after, about 20 minutes after, about 30 minutes after, about 40 minutes after, about 50 minutes after, about 60 minutes after, about 1 hour after, about 2 hours after, about 3 hours after, about 4 hours after, about 5 hours after, about 6 hours after, about 12 hours after, about 18 hours after, about 24 hours after, about 36 hours after, about 48 hours after, about 72 hours after, about 96 hours after, about 5 days after, about 7 days after, about 10 days after, about 14 days after, about 21 days after, about 4 weeks after, about 6 weeks after, about 8 weeks after, about 12 weeks after, about 16 weeks after, about 20 weeks after or more than 20 weeks after.

Pharmacokinetics

The methods and compositions described herein relate to pharmacokinetics of intravenous administration of chlorotoxin conjugates to a subject. Pharmacokinetics are often described using models, for example, compartmental or noncompartmental models. Compartmental models include but are not limited to monocompartmental model, the two compartmental model, the multicompartmental model or the like. Models are often divided into different compartments and described by the corresponding scheme. For example, one scheme is the absorption, distribution, metabolism and excretion (ADME) scheme. For another example, another scheme is the liberation, absorption, distribution, metabolism and excretion (LADME) scheme. In some aspects, metabolism and excretion are grouped into one compartment referred to as the elimination compartment. For example, liberation includes liberation of the active portion of the composition from the delivery system, absorption includes absorption of the active portion of the composition by the subject, distribution includes distribution of the composition through the blood plasma and to different tissues, metabolism, which includes metabolism or inactivation of the composition and finally excretion, which includes excretion or elimination of the composition or the products of metabolism of the composition. Often, compositions administered intravenously to a subject are subject to multiphasic absorption including but not limited to aspects of tissue distribution and metabolism/excretion. As such, the decrease in plasma concentration of the composition is often biphasic, including, for example an alpha phase and a beta phase, occasionally a gamma, delta or other phase is observed. In some aspects, the bioavailability of the compositions described herein is absolute bioavailability, often 1 or 100% given intravenous administration.

Pharmacokinetics includes determining at least one parameter associated with intravenous administration of chlorotoxin conjugates to a subject. In some aspects, parameters include at least the dose (D), dosing interval (i), area under curve (AUC), maximum concentration ($C_{max}$), minimum concentration reached before a subsequent dose is administered ($C_{min}$), minimum time ($T_{min}$), maximum time to reach $C_{max}$ ($T_{max}$), volume of distribution ($V_d$), back-extrapolated concentration at time 0 ($C_0$), steady state concentration ($C_{ss}$), elimination rate constant ($k_e$), infusion rate ($k_{in}$), clearance (CL), bioavailability (f), fluctuation (% PTF) and elimination half-life ($T_{1/2}$). In another aspect, the $C_{max}$, $C_0$ and AUC increase in a dose-dependent manner.

The compounds described herein have values for at least one of the pharmacokinetic parameters listed herein and known to those of ordinary skill in the art. Often, the values for the pharmacokinetic parameters are recorded, observed, measured, processed, analyzed or the like as data. The pharmacokinetics parameters are any parameters suitable for describing the plasma or serum profiles of chlorotoxin conjugates described herein. For example, the pharmacokinetics profile are often obtained at a time after dosing of, for example, about zero minutes, about 1 minute, about 2 minutes, about 3 minutes, about 4 minutes, about 5 minutes, about 6 minutes, about 7 minutes, about 8 minutes, about 9 minutes, about 10 minutes, about 11 minutes, about 12 minutes, about 13 minutes, about 14 minutes, about 15 minutes, about 16 minutes, about 17 minutes, about 18 minutes, about 19 minutes, about 20 minutes, about 21 minutes, about 22 minutes, about 23 minutes, about 24 minutes, about 25 minutes, about 26 minutes, about 27 minutes, about 28 minutes, about 29 minutes, about 30 minutes, about 31 minutes, about 32 minutes, about 33 minutes, about 34 minutes, about 35 minutes, about 36 minutes, about 37 minutes, about 38 minutes, about 39 minutes, about 40 minutes, about 41 minutes, about 42 minutes, about 43 minutes, about 44 minutes, about 45 minutes, about 46 minutes, about 47 minutes, about 48 minutes, about 49 minutes, about 50 minutes, about 51 minutes, about 52 minutes, about 53 minutes, about 54 minutes, about 55 minutes, about 56 minutes, about 57 minutes, about 58 minutes, about 59 minutes, about 60 minutes, about zero hours, about 0.5 hours, about 1 hour, about 1.5 hours, about 2 hours, about 2.5 hours, about 3 hours, about 3.5 hours, about 4 hours, about 4.5 hours, about 5 hours, about 5.5 hours, about 6 hours, about 6.5 hours, about 7 hours, about 7.5 hours, about 8 hours, about 8.5 hours, about 9 hours, about 9.5 hours, about 10 hours, about 10.5 hours, about 11 hours, about 11.5 hours, about 12 hours, about 12.5 hours, about 13 hours, about 13.5 hours, about 14 hours, about 14.5 hours, about 15 hours, about 15.5 hours, about 16 hours, about 16.5 hours, about 17 hours, about 17.5 hours, about 18 hours, about 18.5 hours, about 19 hours, about 19.5 hours, about 20 hours, about 20.5 hours, about 21 hours, about 21.5 hours, about 22 hours, about 22.5 hours, about 23 hours, about 23.5 hours, or about 24 hours.

The pharmacokinetics parameters are any parameters suitable for describing the plasma or serum profiles of chlorotoxin conjugates described herein. In some aspects, the dose (D) includes by way of example but is not limited to, about 0.01 mg, about 0.02 mg, about 0.03 mg, about 0.5 mg, about 0.07 mg, about 0.1 mg, about 0.2 mg, about 0.3 mg, about 0.35 mg, about 0.375 mg, about 0.4 mg, about 0.5 mg, about 0.6 mg, about 0.7 mg, about 0.75 mg, about 0.8 mg, about 0.9 mg, about 1 mg, about 1.3 mg, about 1.4 mg, about 1.5 mg, about 1.8 mg, about 1.9 mg, about 2 mg, about 2.4 mg, about 3 mg, about 5 mg, about 6 mg, about 7 mg, about 12 mg, about 18 mg or about 60 mg more of chlorotoxin conjugate. In some aspects, the dosing interval (i) includes by way of example but is not limited to, about 12 hours, about 24 hours, about 36 hours, about 48 hours or about 72 hours before surgery.

The pharmacokinetics parameters are any parameters suitable for describing the plasma or serum profiles of chlorotoxin conjugates described herein. In some aspects, the area under curve (AUC) includes by way of example but is not limited to, not less than about 50 hr*ng/mL, not less than about 75 hr*ng/mL, not less than about 100 hr*ng/mL, not less than about 125 hr*ng/mL, not less than about 150 hr*ng/mL, not less than about 175 hr*ng/mL, not less than about 200 hr*ng/mL, not less than about 250 hr*ng/mL, not less than about 300 hr*ng/mL, not less than about 350 hr*ng/mL, not less than about 400 hr*ng/mL, not less than about 500 hr*ng/mL, not less than about 600 hr*ng/mL, not less than about 700 hr*ng/mL, not less than about 800 hr*ng/mL, not less than about 900 hr*ng/mL, not less than about 1000 hr*ng/mL, not less than about 2000 hr*ng/mL, not less than about 3000 hr*ng/mL, not less than about 4000 hr*ng/mL, not less than about 5000 hr*ng/mL, not less than about 6000 hr*ng/mL, not less than about 7000 hr*ng/mL, not less than about 8000 hr*ng/mL, not less than about 9000 hr*ng/mL, not less than about 10000 hr*ng/mL, not less than about 11000 hr*ng/mL, not less than about 12000 hr*ng/mL, not less than about 13000 hr*ng/mL, not less than about 14000 hr*ng/mL, not less than about 15000 hr*ng/mL, not less than about 16000 hr*ng/mL, not less than about 17000 hr*ng/mL, not less than about 18000 hr*ng/mL, not less than about 19000 hr*ng/mL, not less than about 20000 hr*ng/mL, not less than about 21000 hr*ng/mL, not less than about 22000 hr*ng/mL, not less than about 23000 hr*ng/mL, not less than about 24000 hr*ng/mL, not less than about 25000 hr*ng/mL, not less than about 26000 hr*ng/mL, not less than about 27000 hr*ng/mL, not less than about 28000 hr*ng/mL, not less than about 29000 hr*ng/mL, not less than about 30000 hr*ng/mL, not less than about 31000 hr*ng/mL, not less than about 32000 hr*ng/mL, not less than about 33000 hr*ng/mL, not less than about 34000 hr*ng/mL, not less than about 35000 hr*ng/mL, not less than about 40000 hr*ng/mL not less than about 45000 hr*ng/mL not less than about 50000 hr*ng/mL not less than about 55000 hr*ng/mL not less than about 60000 hr*ng/mL not less than about 65000 hr*ng/mL not less than about 70000 hr*ng/mL not less than about 75000 hr*ng/mL not less than about 80000 hr*ng/mL not less than about 85000 hr*ng/mL not less than about 90000 hr*ng/mL not less than about 95000 hr*ng/mL not less than about 100000 hr*ng/mL not less than about 125000 hr*ng/mL not less than about 150000 hr*ng/mL not less than about 175000 hr*ng/mL not less than about 200000 hr*ng/mL not less than about 250000 hr*ng/mL not less than about 300000 hr*ng/mL not less than about 350000 hr*ng/mL not less than about 400000 hr*ng/mL not less than about 450000 hr*ng/mL not less than about 500000 hr*ng/mL not less than about 550000 hr*ng/mL not less than about 600000 hr*ng/mL not less than about 650000 hr*ng/mL not less than about 700000 hr*ng/mL not less than about 750000 hr*ng/mL not less than about 800000 hr*ng/mL not less than about 850000 hr*ng/mL not less than about 900000 hr*ng/mL not less than about 950000 hr*ng/mL not less than about 1000000 hr*ng/mL not less than about 1100000 hr*ng/mL not less than about 1200000 hr*ng/mL not less than about 1300000 hr*ng/mL not less than about 1400000 hr*ng/mL not less than about 1500000 hr*ng/mL not less than about 1600000 hr*ng/mL not less than about 1700000 hr*ng/mL not less than about 1800000 hr*ng/mL not less than about 1900000 hr*ng/mL not less than about 2000000 hr*ng/mL or any other AUC appropriate for describing a pharmacokinetic profile of a chlorotoxin conjugate described herein.

The AUC of a chlorotoxin described herein by way of example can be, but is not limited to, about 1,000 hr*ng/mL to about 1,250 hr*ng/mL; about 1,250 hr*ng/mL to about 1,500 hr*ng/mL; about 1,500 hr*ng/mL to about 1,750 hr*ng/mL; about 1,750 hr*ng/mL to about 2,000 hr*ng/mL; about 2,000 hr*ng/mL to about 2,500 hr*ng/mL; about 2,500 hr*ng/mL to about 3,000 hr*ng/mL; about 3,000 hr*ng/mL to about 3,500 hr*ng/mL; about 3,500 hr*ng/mL to about 4,000 hr*ng/mL; about 4,000 hr*ng/mL to about 4,500 hr*ng/mL; about 4,500 hr*ng/mL to about 5,000 hr*ng/mL; about 5,000 hr*ng/mL to about 5,500 hr*ng/mL; about 5,500 hr*ng/mL to about 6,000 hr*ng/mL; about 6,000 hr*ng/mL to about 6,500 hr*ng/mL; about 6,500 hr*ng/mL to about 7,000 hr*ng/mL; about 7,000 hr*ng/mL to about 7,500 hr*ng/mL; about 7,500 hr*ng/mL to about 8,000 hr*ng/mL; about 8,000 hr*ng/mL to about 8,500 hr*ng/mL; about 8,500 hr*ng/mL to about 9,000 hr*ng/mL; about 9,000 hr*ng/mL to about 9,500 hr*ng/mL; about 9,500 hr*ng/mL to about 10,000 hr*ng/mL; about 10,000 hr*ng/mL to about 20,000 hr*ng/mL; about 20,000 hr*ng/mL to about 30,000 hr*ng/mL; about 30,000 hr*ng/mL to about 40,000 hr*ng/mL; about 40,000 hr*ng/mL to about 50,000 hr*ng/mL; about 50,000 hr*ng/mL to about 60,000 hr*ng/mL; about 60,000 hr*ng/mL to about 70,000 hr*ng/mL; about 70,000 hr*ng/mL to about 80,000 hr*ng/mL; about 80,000 hr*ng/mL to about 90,000 hr*ng/mL; about 90,000 hr*ng/mL to about 100,000 hr*ng/mL; about 100,000 hr*ng/mL to about 150,000 hr*ng/mL; about 150,000 hr*ng/mL to about 200,000 hr*ng/mL; about 200,000 hr*ng/mL to about 250,000 hr*ng/mL; about 250,000 hr*ng/mL to about 300,000 hr*ng/mL; about 300,000 hr*ng/mL to about 350,000 hr*ng/mL; about 350,000 hr*ng/mL to about 400,000 hr*ng/mL; about 400,000 hr*ng/mL to about 450,000 hr*ng/mL; about 450,000 hr*ng/mL to about 500,000 hr*ng/mL; about 500,000 hr*ng/mL to about 550,000 hr*ng/mL; about 550,000 hr*ng/mL to about 600,000 hr*ng/mL; about 600,000 hr*ng/mL to about 650,000 hr*ng/mL; about 650,000 hr*ng/mL to about 700,000 hr*ng/mL; about 700,000 hr*ng/mL to about 750,000 hr*ng/mL; about 750,000 hr*ng/ mL to about 800,000 hr*ng/mL; about 800,000 hr*ng/mL to about 850,000 hr*ng/mL; about 850,000 hr*ng/mL to about 900,000 hr*ng/mL; about 900,000 hr*ng/mL to about 950,000 hr*ng/mL; about 950,000 hr*ng/mL to about 1,000,000 hr*ng/mL; about 1,000,000 hr*ng/mL to about 1,100,000 hr*ng/mL; about 1,100,000 hr*ng/mL to about 1,200,000 hr*ng/mL; about 1,200,000 hr*ng/mL to about 1,300,000 hr*ng/mL; about 1,300,000 hr*ng/mL to about 1,400,000 hr*ng/mL; about 1,40,000 hr*ng/mL to about 1,500,000 hr*ng/mL; or about 1,50,000 hr*ng/mL to about 2,000,000 hr*ng/mL.

The pharmacokinetic parameters is any parameters suitable for describing a chlorotoxin conjugate described herein. The $C_{max}$ includes by way of example but is not limited to not less than about 1 ng/mL; not less than about 5 ng/mL; not less than about 10 ng/mL; not less than about 15 ng/mL; not less than about 20 ng/mL; not less than about 25 ng/mL; not less than about 50 ng/mL; not less than about 75 ng/mL; not less than about 100 ng/mL; not less than about 200 ng/mL; not less than about 300 ng/mL; not less than about 400 ng/mL; not less than about 500 ng/mL; not less than about 600 ng/mL; not less than about 700 ng/mL; not less than about 800 ng/mL; not less than about 900 ng/mL; not less than about 1000 ng/mL; not less than about 1250 ng/mL; not less than about 1500 ng/mL; not less than about 1750 ng/mL; not less than about 2000 ng/mL; not less than about 2100 ng/mL; not less than about 2200 ng/mL; not less than about 2300 ng/mL; not less than about 2400 ng/mL; not less than about 2500 ng/mL; not less than about 2600 ng/mL; not less than about 2700 ng/mL; not less than about 2800 ng/mL; not less than about 2900 ng/mL; not less than about 3000 ng/mL; not less than about 3100 ng/mL; not less than about 32000 ng/mL; not less than about 3300 ng/mL; not less than about 3400 ng/mL; not less than about 3500 ng/mL; not less than about 3600 ng/mL; not less than about 3700 ng/mL; not less than about 3800 ng/mL; not less than about 3900 ng/mL; not less than about 4000 ng/mL; not less than about 4500 ng/mL; not less than about 5000 ng/mL; not less than about 5500 ng/mL; not less than about 6000 ng/mL; not less than about 6500 ng/mL; not less than about 2700 ng/mL; not less than about 7500 ng/mL; not less than about 8000 ng/mL; not less than about 8500 ng/mL; not less than about 9000 ng/mL; not less than about 9500 ng/mL; not less than about 10000 ng/mL; not less than about 11000 ng/mL; not less than about 12000 ng/mL; not less than about 13000 ng/mL; not less than about 14000 ng/mL; not less than about 15000 ng/mL; not less than about 16000 ng/mL; not less than about 17000 ng/mL; not less than about 18000 ng/mL; not less than about 19000 ng/mL; not less than about 20000 ng/mL; not less than about 25000 ng/mL; not less than about 30000 ng/mL; not less than about 35000 ng/mL; not less than about 40000 ng/mL; not less than about 45000 ng/mL; not less than about 50000 ng/mL; not less than about 55000 ng/mL; not less than about 60000 ng/mL; not less than about 65000 ng/mL; not less than about 70000 ng/mL; not less than about 750000 ng/mL; not less than about 80000 ng/mL; not less than about 85000 ng/mL; not less than about 90000 ng/mL; not less than about 95000 ng/mL; not less than about 100000 ng/mL; or any other $C_{max}$ appropriate for describing a pharmacokinetic profile of a chlorotoxin conjugate described herein. The $C_{max}$ is, for example, about 1 ng/mL to about 100,000 ng/mL; about 1 ng/mL to about 95.00 ng/mL; about 1 ng/mL to about 90,000 ng/mL; about 1 ng/mL to about 8500 ng/mL; about 1 ng/mL to about 80000 ng/mL; about 1 ng/mL to about 7500 ng/mL; about 1 ng/mL to about 70,000 ng/mL; about 1 ng/mL to about 65 00 ng/mL; about 1 ng/mL to about 60,000 ng/mL; about 1 ng/mL to about 55000 ng/mL; about 1 ng/mL to about 50000 ng/mL; about 1 ng/mL to about 40000 ng/mL; about 1 ng/mL to about 30000 ng/mL; about 1 ng/mL to about 20000 ng/mL; about 1 ng/mL to about 10000 ng/mL; about 1 ng/mL to about 5000 ng/mL; about 1 ng/mL to about 1000 ng/mL; about 1 ng/mL to about 500 ng/mL; about 1 ng/mL to about 500 ng/mL; about 1 ng/mL to about 1000 ng/mL; about 1 ng/mL to about 5000 ng/mL; about 10000 ng/mL to about 5,000 ng/mL; about 10 ng/mL to about 7,000 ng/mL; about 10 ng/mL to about 10,000 ng/mL; about 10 ng/mL to about 10,500 ng/mL; about 10 ng/mL to about 100,000 ng/mL; about 10 ng/mL to about 90000 ng/mL; about 10 ng/mL to about 80000 ng/mL; about 10 ng/mL to about 70000 ng/mL; about 10 ng/mL to about 60000 ng/mL; about 10 ng/mL to about 50000 ng/mL; about 10 ng/mL to about 40000 ng/mL; about 10 ng/mL to about 30000 ng/mL; about 10 ng/mL to about 20000 ng/mL; about 10 ng/mL to about 10000 ng/mL; about 10 ng/mL to about 5000 ng/mL; about 25000 ng/mL to about 50000 ng/mL; about 250 ng/mL to about 10000 ng/mL; about 500 ng/mL to about 50000 ng/mL; about 50 ng/mL to about 10000 ng/mL; about 100 ng/mL to about 50000 ng/mL; about 100 ng/mL to about 40000 ng/mL; about 100 ng/mL to about 30000 ng/mL; or about 100 ng/mL to about 20000 ng/mL.

The plasma concentration of a chlorotoxin conjugate described herein includes by way of example but is not limited to, not less than about 1 ng/mL, not less than about 2 ng/mL, not less than about 3 ng/mL, not less than about 4 ng/mL, not less than about 5 ng/mL, not less than about 6 ng/mL, not less than about 7 ng/mL, not less than about 8 ng/mL, not less than about 9 ng/mL, not less than about 10 ng/mL, not less than about 11 ng/mL, not less than about 12 ng/mL, not less than about 13 ng/mL, not less than about 14 ng/mL, not less than about 15 ng/mL, not less than about 16 ng/mL, not less than about 17 ng/mL, not less than about 18 ng/mL, not less than about 19 ng/mL, not less than about 20 ng/mL, not less than about 21 ng/mL, not less than about 22 ng/mL, not less than about 23 ng/mL, not less than about 24 ng/mL, not less than about 25 ng/mL, not less than about 26 ng/mL, not less than about 27 ng/mL, not less than about 28 ng/mL, not less than about 29 ng/mL, not less than about 30 ng/mL, not less than about 31 ng/mL, not less than about 32 ng/mL, not less than about 33 ng/mL, not less than about 34 ng/mL, not less than about 35 ng/mL, not less than about 36 ng/mL, not less than about 37 ng/mL, not less than about 38 ng/mL, not less than about 39 ng/mL, not less than about 40 ng/mL, not less than about 41 ng/mL, not less than about 42 ng/mL, not less than about 43 ng/mL, not less than about 44 ng/mL, not less than about 45 ng/mL, not less than about 46 ng/mL, not less than about 47 ng/mL, not less than about 48 ng/mL, not less than about 49 ng/mL, not less than about 50 ng/mL, not less than about 51 ng/mL, not less than about 52 ng/mL, not less than about 53 ng/mL, not less than about 54 ng/mL, not less than about 55 ng/mL, not less than about 56 ng/mL, not less than about 57 ng/mL, not less than about 58 ng/mL, not less than about 59 ng/mL, not less than about 60 ng/mL, not less than about 61 ng/mL, not less than about 62 ng/mL, not less than about 63 ng/mL, not less than about 64 ng/mL, not less than about 65 ng/mL, not less than about 66 ng/mL, not less than about 67 ng/mL, not less than about 68 ng/mL, not less than about 69 ng/mL, not less than about 70 ng/mL, not less than about 71 ng/mL, not less than about 72 ng/mL, not less than about 73 ng/mL, not less than about 74 ng/mL, not less than about 75 ng/mL, not less than about 76 ng/mL, not less than about 77 ng/mL, not less than about 78 ng/mL, not less than about 79 ng/mL, not less than about 80 ng/mL, not less than about 81 ng/mL, not less than about 82 ng/mL, not less than about 83 ng/mL, not less than about 84 ng/mL, not less than about 85 ng/mL, not less than about 86 ng/mL, not less than about 87 ng/mL, not less than about 88 ng/mL, not less than about 89 ng/mL, not less than about 90 ng/mL, not less than about 91 ng/mL, not less than about 92 ng/mL, not less than about 93 ng/mL, not less than about 94 ng/mL, not less than about 95 ng/mL, not less than about 96 ng/mL, not less than about 97 ng/mL, not less than about 98 ng/mL, not less than about 99 ng/mL, not less than about 100 ng/mL, not less than about 105 ng/mL, not less than about 110 ng/mL, not less than about 115 ng/mL, not less than about 120 ng/mL, not less than about 125 ng/mL, not less than about 130 ng/mL, not less than about 135 ng/mL, not less than about 140 ng/mL, not less than about 145 ng/mL, not less than about 150 ng/mL, not less than about 155 ng/mL, not less than about 160 ng/mL, not less than about 165 ng/mL, not less than about 170 ng/mL, not less than about 175 ng/mL, not less than about 180 ng/mL, not less than about 185 ng/mL, not less than about 190 ng/mL, not less than about 195 ng/mL, not less than about 200 ng/mL, not less than about 205 ng/mL, not less than about 210 ng/mL, not less than about 215 ng/mL, not less than about 220 ng/mL, not less than about 225 ng/mL, not less than about 230 ng/mL, not less than about 235 ng/mL, not less than about 240 ng/mL, not less than about 245 ng/mL, not less than about 250 ng/mL, or any other plasma concentration of a chlorotoxin conjugate described herein.

The plasma concentration includes by way of example but is not limited to, about 1 ng/mL to about 2 ng/mL; about 1 ng/mL to about 5 ng/mL; about 5 ng/mL to about 10 ng/mL; about 10 ng/mL to about 25 ng/mL; about 25 ng/mL to about 50 ng/mL; about 50 ng/mL to about 75 ng/mL; about 75 ng/mL to about 100 ng/mL; about 100 ng/mL to about 150 ng/mL; about 100 ng/mL to about 200 ng/mL about 150 ng/mL to about 200 ng/mL; about 200 ng/mL to about 250 ng/mL; about 250 ng/mL to about 300 ng/mL; about 300 ng/mL to about 350 ng/mL; about 350 ng/mL to about 400 ng/mL; about 400 ng/mL to about 450 ng/mL; about 450 ng/mL to about 500 ng/mL; about 500 ng/mL to about 600 ng/mL; about 600 ng/mL to about 700 ng/mL; about 700 ng/mL to about 800 ng/mL; about 800 ng/mL to about 900 ng/mL; about 900 ng/mL to about 1,000 ng/mL; about 1,000 ng/mL to about 1,100 ng/mL; about 1,100 ng/mL to about 1,200 ng/mL; about 1,200 ng/mL to about 1,300 ng/mL; about 1,300 ng/mL to about 1,400 ng/mL; about 1,400 ng/mL to about 1,500 ng/mL; about 1,500 ng/mL to about 1,600 ng/mL; about 1,600 ng/mL to about 1,700 ng/mL; about 1,700 ng/mL to about 1,800 ng/mL; about 1,800 ng/mL to about 1,900 ng/mL; about 1,900 ng/mL to about 2,000 ng/mL; about 2,000 ng/mL to about 3,000 ng/mL; about 3,000 ng/mL to about 4,000 ng/mL; about 4,000 ng/mL to about 5,000 ng/mL; about 5,000 ng/mL to about 6,000 ng/mL; about 6,000 ng/mL to about 7,000 ng/mL; about 7,000 ng/mL to about 8,000 ng/mL; about 8,000 ng/mL to about 9,000 ng/mL; or about 9,000 ng/mL to about 10,000 ng/mL.

The $T_{max}$ of a chlorotoxin conjugate described herein includes by way of example but is not limited to, not greater than about 0.5 minutes, not greater than about 1 minutes, not greater than about 1.5 minutes, not greater than about 2 minutes, not greater than about 2.5 minutes, not greater than about 3 minutes, not greater than about 3.5 minutes, not greater than about 4 minutes, not greater than about 4.5 minutes, not greater than about 5 minutes, or any other $T_{max}$ appropriate for describing a pharmacokinetic profile of a chlorotoxin conjugate described herein. The $T_{max}$ further includes by way of example but is not limited to about 0.1 minutes to about 24 minutes; about 0.1 minutes to about 0.5 minutes; about 0.5 minutes to about 1 minute; about 1 minute to about 1.5 minutes; about 1.5 minutes to about 2 minute; about 2 minutes to about 2.5 minutes; about 2.5 minutes to about 3 minutes; about 3 minutes to about 3.5 minutes; about 3.5 minutes to about 4 minutes; about 4 minutes to about 4.5 minutes; about 4.5 minutes to about 5 minutes; about 5 minutes to about 5.5 minutes; about 5.5 minutes to about 6 minutes; about 6 minutes to about 6.5 minutes; about 6.5 minutes to about 7 minutes; about 7 minutes to about 7.5 minutes; about 7.5 minutes to about 8 minutes; about 8 minutes to about 8.5 minutes; about 8.5 minutes to about 9 minutes; about 9 minutes to about 9.5 minutes; about 9.5 minutes to about 10 minutes; about 10 minutes to about 10.5 minutes; about 10.5 minutes to about 11 minutes; about 11 minutes to about 11.5 minutes; about 11.5 minutes to about 12 minutes; about 12 minutes to about 12.5 minutes; about 12.5 minutes to about 13 minutes; about 13 minutes to about 13.5 minutes; about 13.5 minutes to about 14 minutes; about 14 minutes to about 14.5 minutes; about 14.5 minutes to about 15 minutes; about 15 minutes to about 15.5 minutes; about 15.5 minutes to about 16 minutes; about 16 minutes to about 16.5 minutes; about 16.5 minutes to about 17 minutes; about 17 minutes to about 17.5 minutes; about 17.5 minutes to about 18 minutes; about 18 minutes to about 18.5 minutes; about 18.5 minutes to about 19 minutes; about 19 minutes to about 19.5 minutes; about 19.5 minutes to about 20 minutes; about 20 minutes to about 20.5 minutes; about 20.5 minutes to about 21 minutes; about 21 minutes to about 21.5 minutes; about 21.5 minutes to about 22 minutes; about 22 minutes to about 22.5 minutes; about 22.5 minutes to about 23 minutes; about 23 minutes to about 23.5 minutes; about 23.5 minutes to about 24 minutes; about 24 minutes to about 25 minutes; about 25 minutes to about 25.5 minutes; about 25.5 minutes to about 26 minutes; about 26 minutes to about 26.5 minutes; about 26.5 minutes to about 27 minutes; about 27 minutes to about 28 minutes; about 28 minutes to about 28.5 minutes; about 28.5 minutes to about 29 minutes; about 29 minutes to about 29.5 minutes; about 29.5 minutes to about 30 minutes; about 30 minutes to about 31 minutes; about 31 minutes to about 31.5 minutes; about 31.5 minutes to about 32 minutes; about 32 minutes to about 32.5 minutes; about 32.5 minutes to about 33 minutes; about 33 minutes to about 34 minutes; about 34 minutes to about 35 minutes; about 35 minutes to about 36 minutes; about 36 minutes to about 37 minutes; about 37 minutes to about 38 minutes; about 38 minutes to about 39 minutes; about 39 minutes to about 40 minutes; about 40 minutes to about 41 minutes; about 41 minutes to about 42 minutes; about 42 minutes to about 43 minutes; about 43 minutes to about 44 minutes; about 44 minutes to about 45 minutes; about 45 minutes to about 46 minutes; about 46 minutes to about 47 minutes; about 47 minutes to about 48 minutes; about 48 minutes to about 49 minutes; about 49 minutes to about 50 minutes; about 50 minutes to about 51 minutes; about 51 minutes to about 52 minutes; about 52 minutes to about 53 minutes; about 53 minutes to about 55 minutes; about 55 minutes to about 56 minutes; about 56 minutes to about 57 minutes; about 57 minutes to about 58 minutes; about 58 minutes to about 59 minutes; about 59 minutes to about 60 minutes; or any other $T_{max}$ of a chlorotoxin conjugate described herein of a chlorotoxin conjugate described herein.

The $T_{m}ax$ of a chlorotoxin conjugate described herein includes by way of example but is not limited to, not greater than about 0.5 hours, not greater than about 1 hours, not greater than about 1.5 hours, not greater than about 2 hours, not greater than about 2.5 hours, not greater than about 3 hours, not greater than about 3.5 hours, not greater than about 4 hours, not greater than about 4.5 hours, not greater than about 5 hours, or any other $T_{max}$ appropriate for describing a pharmacokinetic profile of a chlorotoxin conjugate described herein. The $T_{max}$ further includes by way of example but is not limited to about 0.1 hours to about 24 hours; about 0.1 hours to about 0.5 hours; about 0.5 hours to about 1 hour; about 1 hour to about 1.5 hours; about 1.5 hours to about 2 hour; about 2 hours to about 2.5 hours; about 2.5 hours to about 3 hours; about 3 hours to about 3.5 hours; about 3.5 hours to about 4 hours; about 4 hours to about 4.5 hours; about 4.5 hours to about 5 hours; about 5 hours to about 5.5 hours; about 5.5 hours to about 6 hours; about 6 hours to about 6.5 hours; about 6.5 hours to about 7 hours; about 7 hours to about 7.5 hours; about 7.5 hours to about 8 hours; about 8 hours to about 8.5 hours; about 8.5 hours to about 9 hours; about 9 hours to about 9.5 hours; about 9.5 hours to about 10 hours; about 10 hours to about 10.5 hours; about 10.5 hours to about 11 hours; about 11 hours to about 11.5 hours; about 11.5 hours to about 12 hours; about 12 hours to about 12.5 hours; about 12.5 hours to about 13 hours; about 13 hours to about 13.5 hours; about 13.5 hours to about 14 hours; about 14 hours to about 14.5 hours; about 14.5 hours to about 15 hours; about 15 hours to about 15.5 hours; about 15.5 hours to about 16 hours; about 16 hours to about 16.5 hours; about 16.5 hours to about 17 hours; about 17 hours to about 17.5 hours; about 17.5 hours to about 18 hours; about 18 hours to about 18.5 hours; about 18.5 hours to about 19 hours; about 19 hours to about 19.5 hours; about 19.5 hours to about 20 hours; about 20 hours to about 20.5 hours; about 20.5 hours to about 21 hours; about 21 hours to about 21.5 hours; about 21.5 hours to about 22 hours; about 22 hours to about 22.5 hours; about 22.5 hours to about 23 hours; about 23 hours to about 23.5 hours; about 23.5 hours to about 24 hours; about 24 hours to about 25 hours; about 25 hours to about 25.5 hours; about 25.5 hours to about 26 hours; about 26 hours to about 26.5 hours; about 26.5 hours to about 27 hours; about 27 hours to about 28 hours; about 28 hours to about 28.5 hours; about 28.5 hours to about 29 hours; about 29 hours to about 29.5 hours; about 29.5 hours to about 30 hours; about 30 hours to about 31 hours; about 31 hours to about 31.5 hours; about 31.5 hours to about 32 hours; about 32 hours to about 32.5 hours; about 32.5 hours to about 33 hours; about 33 hours to about 34 hours; about 34 hours to about 35 hours; about 35 hours to about 36 hours; about 36 hours to about 37 hours; about 37 hours to about 38 hours; about 38 hours to about 39 hours; about 39 hours to about 40 hours; about 40 hours to about 41 hours; about 41 hours to about 42 hours; about 42 hours to about 43 hours; about 43 hours to about 44 hours; about 45 hours to about 46 hours; about 46 hours to about 47 hours; about 47 hours to about 48 hours; about 48 hours to about 49 hours; about 49 hours to about 50 hours; about 50 hours to about 51 hours; about 51 hours to about 52 hours; about 52 hours to about 53 hours; about 53 hours to about 55 hours; about 55 hours to about 56 hours; about 56 hours to about 57 hours; about 57 hours to about 58 hours; about 58 hours to about 59 hours; about 59 hours to about 60 hours; about 60 hours to about 61 hours; about 61 hours to about 62 hours; about 62 hours to about 63 hours; about 63 hours to about 64 hours; about 64 hours to about 66 hours; about 66 hours to about 67 hours; about 67 hours to about 68 hours; about 68 hours to about 69 hours; about 69 hours to about 70 hours; about 70 hours to about 71 hours; about 71 hours to about 72 hours; about 72 hours to about 73 hours; about 73 hours to about 74 hours; about 774 hours to about 75 hours; about 75 hours to about 77 hours; about 77 hours to about 78 hours; about 78 hours to about 79 hours; about 79 hours to about 80 hours; about 80 hours to about 81 hours; about 81 hours to about 82 hours; about 82 hours to about 83 hours; about 83 hours to about 84 hours; about 84 hours to about 85 hours; about 85 hours to about 87 hours; about 87 hours to about 88 hours; about 88 hours to about 89 hours; about 89 hours to about 90 hours; about 90 hours to about 91 hours; about 91 hours to about 92 hours; about 92 hours to about 93 hours; about 93 hours to about 94 hours; about 94 hours to about 95 hours; about 95 hours to about 97 hours; about 97 hours to about 99 hours; about 99 hours to about 100 hours; or any other $T_{m}ax$ of a chlorotoxin conjugate described herein of a chlorotoxin conjugate described herein.

In some aspects, the chlorotoxin conjugates distribute into the subject tissues. For example, distribution into the tissues is often rapid compared to the elimination phase. In some aspects, the chlorotoxin conjugates are eliminated from the subject tissues. For example, elimination from the subject tissues is often slow compared to the distribution phase. Often the kidney is important in the clearance and elimination of the chlorotoxin conjugates, often contributing to the elimination phase.

The pharmacokinetics parameters are any parameters suitable for describing the plasma profiles of chlorotoxin conjugates described herein and are often associated with a curve. As described elsewhere herein, dose is either scaled or fixed, said scaled dose useful for scaling the dose from one subject to another wherein the subjects are the same species, different species, same sex or different sex. The phases of the curve are often representative of data obtained from at least one subject, sometimes more than one subject, and the phases of the curve and/or data of the curve is often scaled in a manner similar to the manner in which doses are scaled.

In some aspects, the curve is plotted on a graph, often a graph with an x-axis and a y-axis referred to for example as an x-y plot, a scatter plot or the like. Each axis of the graph has units, the y-axis often having units of time, for example in hours, and x-axis often having units of concentration, for example as ng/mL, of a chlorotoxin conjugate described herein present in a subject sample as described herein and are representative of a single measurement, a mean, an average, or any other suitable mathematical calculation performed on a set of data. When a suitable mathematical calculation is performed, a statistic is also calculated, for example, a standard error, standard error of the mean, standard deviation, standard deviation of the mean, or any other suitable statistic useful for the described disclosure.

In some aspects, the curve has phases, for example, distribution phase, metabolism phase and elimination phase. In some aspects, the distribution phase begins at time of about 0 hours and extends until a time of about 0.01 hours, about 0.02 hours, about 0.03 hours, about 0.04 hours, about 0.05 hours, about 0.06 hours, about 0.07 hours, about 0.08 hours, about 0.09 hours, about 0.11 hours, about 0.12 hours, about 0.13 hours, about 0.14 hours, about 0.15 hours, about 0.16 hours, about 0.17 hours, about 0.18 hours, about 0.19 hours, about 0.20 hours, 0.21 hours, about 0.22 hours, about 0.23 hours, about 0.24 hours, about 0.25 hours, about 0.26 hours, about 0.27 hours, about 0.28 hours, about 0.29 hours, about 0.30 hours, about 0.31 hours, about 0.32 hours, about 0.33 hours, about 0.34 hours, about 0.35 hours, about 0.36 hours, about 0.37 hours, about 0.38 hours, about 0.39 hours, about 0.40 hours, about 0.41 hours, about 0.42 hours, about 0.43 hours, about 0.44 hours, about 0.45 hours, about 0.46 hours, about 0.47 hours, about 0.48 hours, about 0.49 hours, about 0.50 hours, about 0.51 hours, about 0.52 hours, about 0.53 hours, about 0.54 hours, about 0.55 hours, about 0.56 hours, about 0.57 hours, about 0.58 hours, about 0.59 hours, about 0.60 hours, about 0.61 hours, about 0.62 hours, about 0.63 hours, about 0.64 hours, about 0.65 hours, about 0.66 hours, about 0.67 hours, about 0.68 hours, about 0.69 hours, about 0.70 hours, about 0.71 hours, about 0.72 hours, about 0.73 hours, about 0.74 hours, about 0.75 hours, about 0.76 hours, about 0.77 hours, about 0.78 hours, about 0.79 hours, about 0.80 hours, about 0.81 hours, about 0.82 hours, about 0.83 hours, about 0.84 hours, about 0.85 hours, about 0.86 hours, about 0.87 hours, about 0.88 hours, about 0.89 hours, about 0.90 hours, about 0.91 hours, about 0.92 hours, about 0.93 hours, about 0.94 hours, about 0.95 hours, about 0.96 hours, about 0.97 hours, about 0.98 hours, about 0.99 hours, about 1.00 hours, about 1.01 hours, about 1.02 hours, about 1.03 hours, about 1.04 hours, about 1.05 hours, about 1.06 hours, about 1.07 hours, about 1.08 hours, about 1.09 hours, about 1.11 hours, about 1.12 hours, about 1.13 hours, about 1.14 hours, about 1.15 hours, about 1.16 hours, about 1.17 hours, about 1.18 hours, about 1.19 hours, about 1.20 hours, 1.21 hours, about 1.22 hours, about 1.23 hours, about 1.24 hours, about 1.25 hours, about 1.26 hours, about 1.27 hours, about 1.28 hours, about 1.29 hours, about 1.30 hours, about 1.31 hours, about 1.32 hours, about 1.33 hours, about 1.34 hours, about 1.35 hours, about 1.36 hours, about 1.37 hours, about 1.38 hours, about 1.39 hours, about 1.40 hours, about 1.41 hours, about 1.42 hours, about 1.43 hours, about 1.44 hours, about 1.45 hours, about 1.46 hours, about 1.47 hours, about 1.48 hours, about 1.49 hours, about 1.50 hours, about 1.51 hours, about 1.52 hours, about 1.53 hours, about 1.54 hours, about 1.55 hours, about 1.56 hours, about 1.57 hours, about 1.58 hours, about 1.59 hours, about 1.60 hours, about 1.61 hours, about 1.62 hours, about 1.63 hours, about 1.64 hours, about 1.65 hours, about 1.66 hours, about 1.67 hours, about 1.68 hours, about 1.69 hours, about 1.70 hours, about 1.71 hours, about 1.72 hours, about 1.73 hours, about 1.74 hours, about 1.75 hours, about 1.76 hours, about 1.77 hours, about 1.78 hours, about 1.79 hours, about 1.80 hours, about 1.81 hours, about 1.82 hours, about 1.83 hours, about 1.84 hours, about 1.85 hours, about 1.86 hours, about 1.87 hours, about 1.88 hours, about 1.89 hours, about 1.90 hours, about 1.91 hours, about 1.92 hours, about 1.93 hours, about 1.94 hours, about 1.95 hours, about 1.96 hours, about 1.97 hours, about 1.98 hours, about 1.99 hours, about 2.00 hours, about 2.20 hours, about 2.40 hours, about 2.60 hours, about 2.80 hours, about 3.00 hours, about 4.20 hours, about 4.40 hours, about 4.60 hours, about 4.80 hours, about 5.00 hours, about 5.20 hours, about 5.40 hours, about 5.60 hours, about 5.80 hours, about 6.00 hours, about 6.20 hours, about 6.40 hours, about 6.60 hours, about 6.80 hours, about 7.00 hours, about 7.20 hours, about 7.40 hours, about 7.60 hours, about 7.80 hours, about 8.00 hours, about 8.20 hours, about 8.40 hours, about 8.60 hours, about 8.80 hours, about 9.00 hours, about 9.20 hours, about 9.40 hours, about 9.60 hours, about 9.80 hours, about 10.00 hours or more than about 10.00 hours.

In some aspects, the metabolism phase begins at time of about 0.5 hours and extends until a time of about 0.50 hours, about 0.51 hours, about 0.52 hours, about 0.53 hours, about 0.54 hours, about 0.55 hours, about 0.56 hours, about 0.57 hours, about 0.58 hours, about 0.59 hours, about 0.60 hours, about 0.61 hours, about 0.62 hours, about 0.63 hours, about 0.64 hours, about 0.65 hours, about 0.66 hours, about 0.67 hours, about 0.68 hours, about 0.69 hours, about 0.70 hours, about 0.71 hours, about 0.72 hours, about 0.73 hours, about 0.74 hours, about 0.75 hours, about 0.76 hours, about 0.77 hours, about 0.78 hours, about 0.79 hours, about 0.80 hours, about 0.81 hours, about 0.82 hours, about 0.83 hours, about 0.84 hours, about 0.85 hours, about 0.86 hours, about 0.87 hours, about 0.88 hours, about 0.89 hours, about 0.90 hours, about 0.91 hours, about 0.92 hours, about 0.93 hours, about 0.94 hours, about 0.95 hours, about 0.96 hours, about 0.97 hours, about 0.98 hours, about 0.99 hours, about 1.00 hours, about 1.01 hours, about 1.02 hours, about 1.03 hours, about 1.04 hours, about 1.05 hours, about 1.06 hours, about 1.07 hours, about 1.08 hours, about 1.09 hours, about 1.11 hours, about 1.12 hours, about 1.13 hours, about 1.14 hours, about 1.15 hours, about 1.16 hours, about 1.17 hours, about 1.18 hours, about 1.19 hours, about 1.20 hours, 1.21 hours, about 1.22 hours, about 1.23 hours, about 1.24 hours, about 1.25 hours, about 1.26 hours, about 1.27 hours, about 1.28 hours, about 1.29 hours, about 1.30 hours, about 1.31 hours, about 1.32 hours, about 1.33 hours, about 1.34 hours, about 1.35 hours, about 1.36 hours, about 1.37 hours, about 1.38 hours, about 1.39 hours, about 1.40 hours, about 1.41 hours, about 1.42 hours, about 1.43 hours, about 1.44 hours, about 1.45 hours, about 1.46 hours, about 1.47 hours, about 1.48 hours, about 1.49 hours, about 1.50 hours, about 1.51 hours, about 1.52 hours, about 1.53 hours, about 1.54 hours, about 1.55 hours, about 1.56 hours, about 1.57 hours, about 1.58 hours, about 1.59 hours, about 1.60 hours, about 1.61 hours, about 1.62 hours, about 1.63 hours, about 1.64 hours, about 1.65 hours, about 1.66 hours, about 1.67 hours, about 1.68 hours, about 1.69 hours, about 1.70 hours, about 1.71 hours, about 1.72 hours, about 1.73 hours, about 1.74 hours, about 1.75 hours, about 1.76 hours, about 1.77 hours, about 1.78 hours, about 1.79 hours, about 1.80 hours, about 1.81 hours, about 1.82 hours, about 1.83 hours, about 1.84 hours, about 1.85 hours, about 1.86 hours, about 1.87 hours, about 1.88 hours, about 1.89 hours, about 1.90 hours, about 1.91 hours, about 1.92 hours, about 1.93 hours, about 1.94 hours, about 1.95 hours, about 1.96 hours, about 1.97 hours, about 1.98 hours, about 1.99 hours, about 2.00 hours, about 2.20 hours, about 2.40 hours, about 2.60 hours, about 2.80 hours, about 3.00 hours, about 4.20 hours, about 4.40 hours, about 4.60 hours, about 4.80 hours, about 5.00 hours, about 5.20 hours, about 5.40 hours, about 5.60 hours, about 5.80 hours, about 6.00 hours, about 6.20 hours, about 6.40 hours, about 6.60 hours, about 6.80 hours, about 7.00 hours, about 7.20 hours, about 7.40 hours, about 7.60 hours, about 7.80 hours, about 8.00 hours, about 8.20 hours, about 8.40 hours, about 8.60 hours, about 8.80 hours, about 9.00 hours, about 9.20 hours, about 9.40 hours, about 9.60 hours, about 9.80 hours, about 10.00 hours, about 10.20 hours, about 10.40 hours, about 10.60 hours, about 10.80 hours, about 12.00 hours, about 12.20 hours, about 12.40 hours, about 12.60 hours, about 12.80 hours, about 14.00 hours, about 14.20 hours, about 14.40 hours, about 14.60 hours, about 14.80 hours, about 16.00 hours, about 16.20 hours, about 16.40 hours, about 16.60 hours, about 16.80 hours, about 18.00 hours, about 18.20 hours, about 18.40 hours, about 18.60 hours, about 18.80 hours, about 20.00 hours, about 20.20 hours, about 20.40 hours, about 20.60 hours, about 20.80 hours, about 22.00 hours, about 22.20 hours, about 22.40 hours, about 22.60 hours, about 22.80 hours, about 24.00 hours, about 24.20 hours, about 24.40 hours, about 24.60 hours, about 24.80 hours, about 26.00 hours, about 26.20 hours, about 26.40 hours, about 26.60 hours, about 26.80 hours, about 28.00 hours, about 28.20 hours, about 28.40 hours, about 28.60 hours, about 28.80 hours, about 30 hours or more than about 30.00 hours.

In some aspects, the elimination phase begins at time of about 2 hours and extends until a time of about 2.00 hours, about 2.20 hours, about 2.40 hours, about 2.60 hours, about 2.80 hours, about 3.00 hours, about 4.20 hours, about 4.40 hours, about 4.60 hours, about 4.80 hours, about 5.00 hours, about 5.20 hours, about 5.40 hours, about 5.60 hours, about 5.80 hours, about 6.00 hours, about 6.20 hours, about 6.40 hours, about 6.60 hours, about 6.80 hours, about 7.00 hours, about 7.20 hours, about 7.40 hours, about 7.60 hours, about 7.80 hours, about 8.00 hours, about 8.20 hours, about 8.40 hours, about 8.60 hours, about 8.80 hours, about 9.00 hours, about 9.20 hours, about 9.40 hours, about 9.60 hours, about 9.80 hours, about 10.00 hours, about 10.20 hours, about 10.40 hours, about 10.60 hours, about 10.80 hours, about 12.00 hours, about 12.20 hours, about 12.40 hours, about 12.60 hours, about 12.80 hours, about 14.00 hours, about 14.20 hours, about 14.40 hours, about 14.60 hours, about 14.80 hours, about 16.00 hours, about 16.20 hours, about 16.40 hours, about 16.60 hours, about 16.80 hours, about 18.00 hours, about 18.20 hours, about 18.40 hours, about 18.60 hours, about 18.80 hours, about 20.00 hours, about 20.20 hours, about 20.40 hours, about 20.60 hours, about 20.80 hours, about 22.00 hours, about 22.20 hours, about 22.40 hours, about 22.60 hours, about 22.80 hours, about 24.00 hours, about 24.20 hours, about 24.40 hours, about 24.60 hours, about 24.80 hours, about 26.00 hours, about 26.20 hours, about 26.40 hours, about 26.60 hours, about 26.80 hours, about 28.00 hours, about 28.20 hours, about 28.40 hours, about 28.60 hours, about 28.80 hours, about 30.00 hours, about 30.20 hours, about 30.40 hours, about 30.60 hours, about 30.80 hours, about 32.00 hours, about 32.20 hours, about 32.40 hours, about 32.60 hours, about 32.80 hours, about 34.00 hours, about 34.20 hours, about 34.40 hours, about 34.60 hours, about 34.80 hours, about 36.00 hours, about 36.20 hours, about 36.40 hours, about 36.60 hours, about 36.80 hours, about 38.00 hours, about 38.20 hours, about 38.40 hours, about 38.60 hours, about 38.80 hours, about 40.00 hours, about 40.20 hours, about 40.40 hours, about 40.60 hours, about 40.80 hours, about 42.00 hours, about 42.20 hours, about 42.40 hours, about 42.60 hours, about 42.80 hours, about 44.00 hours, about 44.20 hours, about 44.40 hours, about 44.60 hours, about 44.80 hours, about 46.00 hours, about 46.20 hours, about 46.40 hours, about 46.60 hours, about 46.80 hours, about 48.00 hours, about 48.20 hours, about 48.40 hours, about 48.60 hours, about 48.80 hours, about 50.00 hours, about 50.20 hours, about 50.40 hours, about 50.60 hours, about 50.80 hours, about 52.00 hours, about 52.20 hours, about 52.40 hours, about 52.60 hours, about 52.80 hours, about 54.00 hours, about 54.20 hours, about 54.40 hours, about 54.60 hours, about 54.80 hours, about 56.00 hours, about 56.20 hours, about 56.40 hours, about 56.60 hours, about 56.80 hours, about 58.00 hours, about 58.20 hours, about 58.40 hours, about 58.60 hours, about 58.80 hours, about 60.00 hours, about 60.20 hours, about 60.40 hours, about 60.60 hours, about 60.80 hours, about 62.00 hours, about 62.20 hours, about 62.40 hours, about 62.60 hours, about 62.80 hours, about 64.00 hours, about 64.20 hours, about 64.40 hours, about 64.60 hours, about 64.80 hours, about 66.00 hours, about 66.20 hours, about 66.40 hours, about 66.60 hours, about 66.80 hours, about 68.00 hours, about 68.20 hours, about 68.40 hours, about 68.60 hours, about 68.80 hours, about 70.00 hours, about 70.20 hours, about 70.40 hours, about 70.60 hours, about 70.80 hours, about 72.00 hours, about 72.20 hours, about 72.40 hours, about 72.60 hours, about 72.80 hours, about 74.00 hours, about 74.20 hours, about 74.40 hours, about 74.60 hours, about 74.80 hours, about 76.00 hours, about 76.20 hours, about 76.40 hours, about 76.60 hours, about 76.80 hours, about 78.00 hours, about 78.20 hours, about 78.40 hours, about 78.60 hours, about 78.80 hours, about 80.00 hours, about 80.20 hours, about 80.40 hours, about 80.60 hours, about 80.80 hours, about 82.00 hours, about 82.20 hours, about 82.40 hours, about 82.60 hours, about 82.80 hours, about 84.00 hours, about 84.20 hours, about 84.40 hours, about 84.60 hours, about 84.80 hours, about 86.00 hours, about 86.20 hours, about 86.40 hours, about 86.60 hours, about 86.80 hours, about 88.00 hours, about 88.20 hours, about 88.40 hours, about 88.60 hours, about 88.80 hours, about 90.00 hours or about more than 90.00 hours.

In some aspects, a single fixed bolus dose intravenous chlorotoxin conjugate often results in mean serum concentrations measurable up to about 12 hours post-dose, about 24 hours post-dose, up to about 36 hours post-dose, up to about 48 hours post-dose or more than about 48 hours post-dose. Often, for subjects such as rats, $C_{max}$ and $C_0$ parameters increase in about a dose-proportional manner. In some aspects, the $AUC_{0-t}$ parameter, for subjects such as rats, is about dose-proportional at less than about a 1 mg dose levels, and increases in a greater than dose-proportional manner at greater than about 1 mg dose levels. Often there is no effect of gender on any PK parameters for subjects such as rats. In some aspects, PK parameters are predictive in rats of a human subject.

In some aspects, a single fixed bolus dose intravenous chlorotoxin conjugate often results in mean serum concentrations measurable up to about 12 hours post-dose, about 24 hours post-dose, up to about 36 hours post-dose, up to about 48 hours post-dose or more than about 48 hours post-dose. Often, for subjects such as rats, $C_{max}$ and $C_0$ parameters increase in about a dose-proportional manner. In some aspects, the $AUC_{0-t}$ parameter, for subjects such as monkeys, is greater than dose-proportional manner at greater than about 1 mg dose levels for example such that chlorotoxin conjugates exhibit reduced clearance at higher doses in monkeys. Often there is an effect of gender on PK parameters for subjects such as monkeys, for example, the $C_0$ and AUC are about 5 to about 30% higher in females relative to males.

As used herein, two pharmacokinetic profiles are “about equivalent” if they are defined by at least one parameter that is about equivalent between the two profiles. Non-limiting examples of such parameters include the area under plasma concentration over time curve (AUC) and the maximal plasma concentration reached following administration of a dose ($C_{max}$).

In some aspects two pharmacokinetic parameters are about equivalent if the lower value is greater than 70%, greater than 75%, greater than 80%, greater than 85%, greater than 90%, greater than 95%, greater than 96%, greater than 97%, greater than 98%, or greater than 99% of the higher value.

The pharmacokinetic profiles of two dosage regimens are compared by determining the average pharmacokinetic profile in a population of subjects receiving the first dosage regimen, determining the average pharmacokinetic profile in a population of subjects receiving the second dosage regimen, and then comparing those two population dosage regimens. In some aspects, a population of subjects is one subject. In other aspects, a population of subjects is more than one subject, for example, two subjects, three subjects, four subjects, five subjects, six subjects, seven subjects, eight subjects, nine subjects, ten subjects, 11 subjects, 12 subjects, 13 subjects, 14 subjects, 15 subjects, 20 subjects, 25 subjects, 30 subjects, 35 subjects, 40 subjects, 45 subjects, 50 subjects, or more than 50 subjects.

In various aspects, the present disclosure provides a method of administering a composition to a human subject, the method comprising: intravenously administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof; and producing in the human subject an average maximum compound blood plasma concentration (average $C_{max}$) of at least from 110 ng/mL to 240 ng/mL per each 1 mg dosage of the compound administered.

In various aspects, the present disclosure provides a method of detecting a cancer cell in a human subject, the method comprising: intravenously administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof conjugated to a detectable label; producing in the human subject an average maximum compound blood plasma concentration (average $C_{max}$) of at least from 110 ng/mL to 240 ng/mL per each 1 mg dosage of the compound administered; and detecting the presence or absence of the detectable label in the human subject, wherein the presence of the detectable label indicates the presence of the cancer cell.

In various aspects, the present disclosure provides a method of diagnosing cancer in a human subject, the method comprising: intravenously administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof conjugated to a detectable label; producing in the human subject an average maximum compound blood plasma concentration (average $C_{max}$) of at least from 110 ng/mL to 240 ng/mL per each 1 mg dosage of the compound administered; and detecting the presence or absence of the detectable label in the human subject, wherein the presence of the detectable label indicates a diagnosis of cancer.

In various aspects, the present disclosure provides a method of treating cancer in a human subject, the method comprising: intravenously administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof conjugated to a therapeutic agent; producing in the human subject an average maximum compound blood plasma concentration (average $C_{max}$) of at least from 110 ng/mL to 240 ng/mL per each 1 mg dosage of the compound administered; and reducing or improving a symptom or condition associated with cancer in the human subject. In some aspects, the human subject is in need thereof. In some aspects, the methods comprise administering a therapeutically effective dose of the compound to the human subject.

Figure 27:
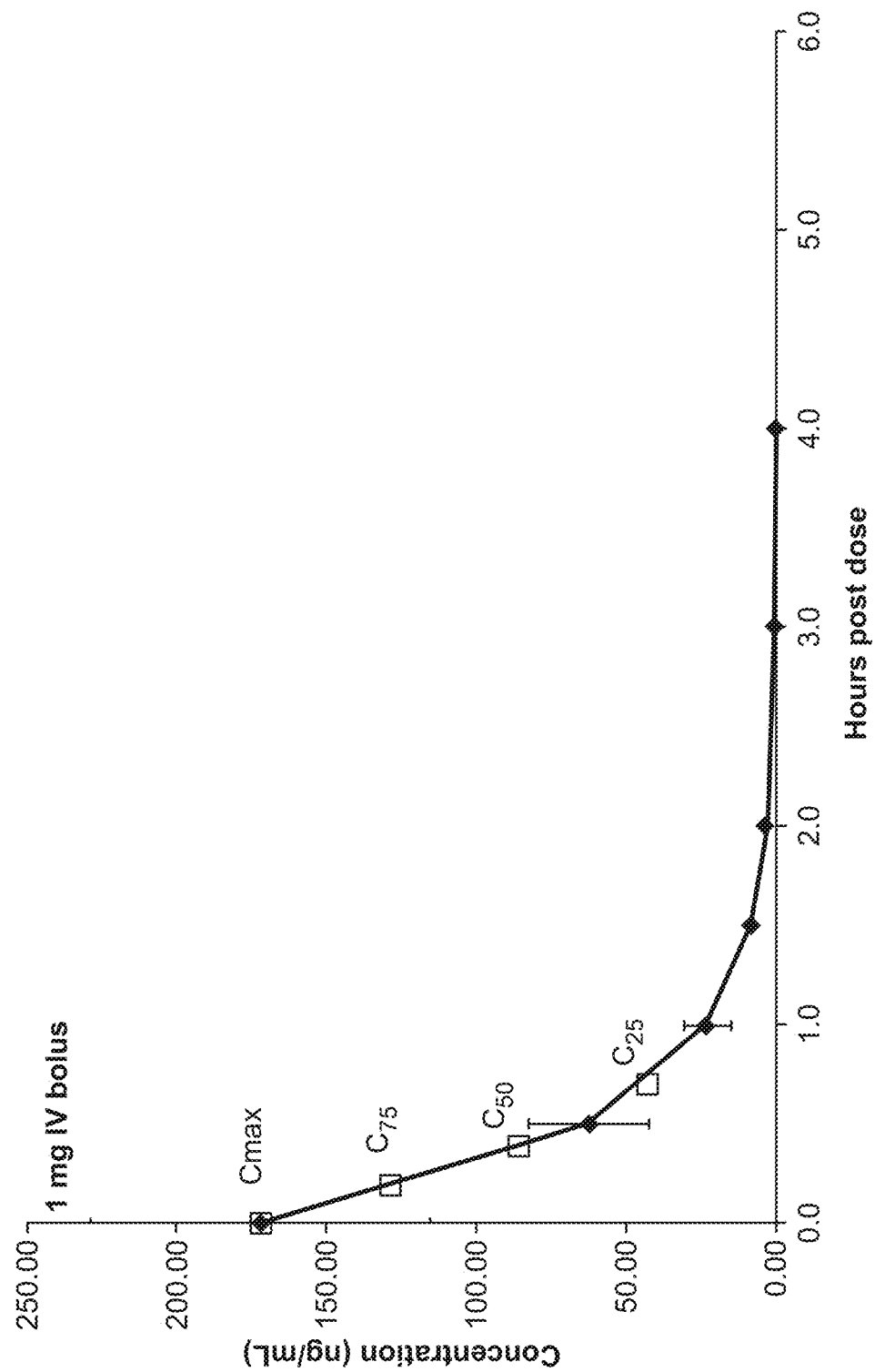
FIG. 27 shows chlorotoxin conjugate serum concentration vs time for human subjects.

In various aspects, the present disclosure provides a method of administering a composition to a human subject, the method comprising: administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof; and producing in the human subject pharmacokinetic profile of FIG. 27.

In various aspects, the present disclosure provides a method of administering a composition to a human subject, the method comprising: intravenously administering to the human subject a dose of from 1 mg to 30 mg of any suitable compound of the present disclosure; and producing in the human subject an average maximum compound blood plasma concentration (average $C_{max}$) of at least from 110 ng/mL to 240 ng/mL per each 1 mg dosage of the compound administered.

In some aspects, the average time (average $T_{max}$) at which the average $C_{max}$ is reached is at 5±4 minutes following administration of the compound. In some aspects, the average time (average $T_{75}$) at which the average compound blood plasma concentration reaches 75% of the average $C_{max}$ (average $C_{75}$) is reached is at 8±5 minutes following administration of the compound. In some aspects, the average time (average $T_{50}$) at which the average compound blood plasma concentration reaches 50% of the average $C_{max}$ (average $C_{50}$) is reached is at 20±8 minutes following administration of the compound. In some aspects, the average time (average $T_{25}$) at which the average compound blood plasma concentration reaches 25% of the average $C_{max}$ (average $C_{25}$) is reached is at 30±12 minutes following administration of the compound.

In some aspects, the methods further comprise producing in the human subject an average chlorotoxin polypeptide plasma area under the curve (average AUC) of from 50 hr*ng/mL to 120 hr*ng/mL per each 1 mg dosage of chlorotoxin polypeptide administered.

In some aspects, the methods further comprise producing in the human subject an average chlorotoxin polypeptide plasma area under the curve (average AUC) of from 60 hr*ng/mL to 110 hr*ng/mL per each 1 mg dosage of chlorotoxin polypeptide administered.

In some aspects, 75% of the average AUC occurs within 40±15 minutes after administering the compound. In some aspects, 50% of the average AUC occurs within 21±8 minutes after administering the compound. In some aspects, 25% of the average AUC occurs within 9±5 minutes after administering the compound.

In some aspects, the compound comprises any suitable compound of the present disclosure.

In various aspects, the present disclosure provides a method for detecting a cancer cell in a subject, the method comprising: administering any suitable compound of the present disclosure; and detecting the presence or absence of the compound in the subject, wherein the presence of the compound indicates the presence of a cancer cell.

In some aspects, the method further comprises administering the compound as a part of a composition.

In some aspects, the cancer is selected from glioma, astrocytoma, medulloblastoma, choroids plexus carcinoma, ependymoma, brain tumor, neuroblastoma, adenocarcinoma, basal cell carcinoma, squamous cell carcinoma, head and neck cancer, lung cancer, breast cancer, intestinal cancer, pancreatic cancer, liver cancer, kidney cancer, sarcoma, osteosarcoma, rhabdomyosarcoma, Ewing's sarcoma, carcinoma, melanoma, ovarian cancer, cervical cancer, lymphoma, thyroid cancer, anal cancer, colo-rectal cancer, endometrial cancer, germ cell tumor, laryngeal cancer, multiple myeloma, prostate cancer, retinoblastoma, gastric cancer, testicular cancer, or Wilm's tumor. In some aspects, the cancer is selected from glioma, medulloblastoma, sarcoma, breast cancer, lung cancer, prostate cancer, or intestinal cancer. In some aspects, the cancer cell expresses a site to which native chlorotoxin binds.

In some aspects, the method comprises detecting the compound by fluorescence imaging.

In some aspects, the method further comprises differentiating a focus of a cancer that expresses a site to which native chlorotoxin binds from non-neoplastic tissue.

In some aspects, the method further comprises surgically removing from the subject a cancer cell that is detected.

In some aspects, the method further comprises determining the location of a cancer cell in the subject before surgically removing the cancer cell from the subject, during surgical removal of the cancer cell from the subject, after removing the cancer cell from the subject, or a combination thereof.

In some aspects, the compound binds to the cancer cell. In some aspects, the subject is a human subject. In some aspects, the detection is performed in vivo or ex vivo.

In various aspects, the present disclosure provides a method of administering any suitable compound of the present disclosure to a subject, the method comprising administering a therapeutically effective amount of the compound to the subject.

In some aspects, the subject is in need thereof.

In some aspects, a therapeutically effective amount is a dosage sufficient for the detection of a cancer cell in the subject. In some aspects, the dosage is from 0.1 mg to 100 mg. In some aspects, dosage is from 1 mg to 30 mg. In some aspects, the dosage is from 3 mg to 30 mg.

In various aspects, the present disclosure provides a method of treating a subject in need thereof, the method comprising administering to the subject any suitable compound of the present disclosure further comprising a therapeutic agent in an amount sufficient to treat cancer in the subject. In certain aspects, the therapeutic agent is a cytotoxic agent.

In some aspects, the cancer is selected from glioma, astrocytoma, medulloblastoma, choroids plexus carcinoma, ependymoma, brain tumor, neuroblastoma, head and neck cancer, lung cancer, breast cancer, intestinal cancer, pancreatic cancer, liver cancer, kidney cancer, sarcoma, osteosarcoma, rhabdomyosarcoma, Ewing's sarcoma, carcinoma, melanoma, ovarian cancer, cervical cancer, lymphoma, thyroid cancer, anal cancer, colo-rectal cancer, endometrial cancer, germ cell tumor, laryngeal cancer, multiple myeloma, prostate cancer, retinoblastoma, gastric cancer, testicular cancer, or Wilm's tumor. In some aspects, the cancer cell is selected from glioma, medulloblastoma, sarcoma, prostate cancer, or intestinal cancer. In certain aspects, the cancer cell expresses a site to which native chlorotoxin binds. In further aspects, the binding is selective.

In some aspects, the compound is administered parenterally. In other aspects, the compound is administered intravenously. In still other aspects, the compound is administered subcutaneously.

Methods for Analysis to Generate Pharmacokinetic Profiles

In some aspects, samples are analyzed to obtain parameters useful to determine a pharmacokinetic profile. Often the samples are diluted, for example, using a buffer or pharmaceutically acceptable carrier as defined herein.

Pharmacokinetic standard curves are often generated using a chlorotoxin conjugate, serum and a pharmaceutical carrier as described herein. The proportion of each chlorotoxin conjugate, concentrated source of sample (for example serum, urine, etc.) and pharmaceutical carrier often differs, for example, the concentration of compound of the present disclosure is often between about 10 μg/mL and about 4 ng/mL. Often the standard curve is used to calculate the concentration of the compound in the sample.

In some aspects, pharmacokinetic parameters, or pharmacokinetic data are analyzed using standard pharmacokinetic data analysis methods, including concentration of chlorotoxin conjugates versus time. For example, a software program, such as Phoenix WinNonlin 6.3 is used to analyze pharmacokinetics data. In some aspects, the pharmacokinetic data analysis uses standard noncompartmental methods of intravenous bolus, intravenous infusion, or extravascular input as appropriate. In other aspects, the pharmacokinetic data analysis uses nonstandard noncompartmental methods of intravenous bolus, intravenous infusion, or extravascular input as appropriate. Often, the data are analyzed by the mean serum concentration versus time. The data are also analyzed by individual subject followed by group summary statistics.

Pharmacokinetic profiles of the compositions described herein are often obtained using at least one, sometimes more than one bioanalytical method. In some aspects, bioanalytical methods include the addition of chemicals to a sample containing a composition of which the pharmacokinetic profile is desired. Addition of the chemical to the sample often comprises performing a chemical technique to measure the concentration of a composition or a metabolite thereof in a sample or, sometimes, in a biological matrix. For example, microscale thermophoresis, mass spectrometry often including liquid chromatograph and a triple quadrupole mass spectrometer, tandem mass spectrometry, high sensitivity mass spectrometry for microdosing studies and the like are often performed.

The disclosure further describes methods of administering compound and compositions of the present disclosure to a subject, often methods include intravenous administration of a chlorotoxin conjugate composition to a subject. In some aspects, the method of administering a chlorotoxin polypeptide to a subject comprises intravenously administering a dose of from 0.8 to 25 mg of the chlorotoxin polypeptide to the subject, wherein the chlorotoxin polypeptide has at least 85% sequence identity with MCMPCFTTDHQMARXCDDCCGGXGRGXCYGPQCL-CR; producing in the subject an average chlorotoxin polypeptide plasma area under the curve (average AUC) of from 50 to 120 per each 1 mg dosage of chlorotoxin polypeptide administered; and producing in the subject an average maximum chlorotoxin peptide blood plasma concentration (average $C_{max}$) of at least from 110 to 240 per each 1 mg dosage of chlorotoxin peptide administered. In some aspects, the chlorotoxin polypeptide is conjugated to a fluorescent agent.

The disclosure further describes methods of treating and/or detecting cancer with chlorotoxin conjugate compositions following administration to a subject or contacting tumor tissue isolated from a subject, often the methods include intravenous administration of a chlorotoxin conjugate composition to a subject, in vivo contact of a tumor tissue or ex vivo contact of a tumor tissue from a subject. In some aspects, the method treating and/or detecting cancer with chlorotoxin conjugate compositions following administration to a subject or contacting tumor tissue isolated from a subject, often the methods include intravenous administration of a chlorotoxin conjugate composition to a subject, in vivo contact of a tumor tissue or ex vivo contact of a tumor tissue from a subject comprises intravenously administering a dose of from 0.8 to 25 mg of the chlorotoxin polypeptide to the subject, wherein the chlorotoxin polypeptide has at least 85% sequence identity with MCMPCFTTDHQMARXCDDCCGGXGRGXCYGPQCL-CR; producing in the subject an average chlorotoxin polypeptide plasma area under the curve (average AUC) of from 50 to 120 per each 1 mg dosage of chlorotoxin polypeptide administered; and producing in the subject an average maximum chlorotoxin peptide blood plasma concentration (average $C_{max}$) of at least from 110 to 240 per each 1 mg dosage of chlorotoxin peptide administered. In some aspects, the chlorotoxin polypeptide is conjugated to a fluorescent agent.

The disclosure further describes compositions of chlorotoxin conjugates, often the chlorotoxin conjugate composition comprises a physiologically effective amount of a chlorotoxin conjugate, wherein the chlorotoxin conjugate comprises a chlorotoxin polypeptide having at least 85% sequence identity with MCMPCFTTDHQMARXCDDCCGGXGRGXCYGPQCL-CR conjugated to a fluorescent dye, for example, as provided in the present disclosure, or a derivative thereof, wherein intravenous administration of the composition to a subject produces in the subject: an average chlorotoxin polypeptide plasma area under the curve (average AUC) of from 50 to 120 per each 1 mg dosage of chlorotoxin polypeptide administered; and an average maximum chlorotoxin peptide blood plasma concentration (average $C_{max}$) of at least from 110 to 240 per each 1 mg dosage of chlorotoxin peptide administered. In some aspects, the chlorotoxin polypeptide is conjugated to a fluorescent agent.

Activity of Chlorotoxin Conjugates

The present disclosure provides, but is not limited to, methods for intraoperative imaging and resection of tumors with chlorotoxin conjugates detectable by fluorescence imaging that allows for intraoperative visualization of cancerous tissues, compositions that include the chlorotoxin conjugate, and methods for using the chlorotoxin conjugate. The chlorotoxin is a targeting agent that directs the conjugate to a tissue of interest. In one aspect, the chlorotoxin conjugate of the disclosure includes one or more labeling agents. In a further aspect, the labeling agent comprises a fluorescent moiety (e.g., red or near infrared emitting fluorescent moieties) covalently coupled to the chlorotoxin. In another aspect, the labeling agent comprises a radionuclide.

The chlorotoxin conjugates described herein are often used for detection and treatment of, for example imaging, resection of, diagnosis of and treatment of tumors. In some aspects, tumors amenable to detection with a chlorotoxin conjugate of the present disclosure include, but are not limited to: adenocarcinoma, fibrosarcoma, hemangiosarcoma, mastocytoma, squamous cell carcinoma, chondrosarcoma, adenosquamous carcinoma, hemangiopericytoma, follicular carcinoma, meningioma, mucosal squamous cell cancer, glioma, sarcomas, such as soft-tissue sarcomas or the like. Soft-tissue sarcomas amenable to detection with a chlorotoxin conjugate of the present disclosure include, but are not limited to: fat tissue tumors, liposarcomas, muscle tissue tumors including smooth muscle sarcomas and leiomyosarcomas, skeletal muscle sarcomas, rhabdomyosarcomas, peripheral nerve tumors, fibrous tissue tumors, myxofibrosarcomas, fibromatosis, joint tissue tumors, tumors of blood vessels and lymph vessels, angiosarcomas, tumors of peripheral nerves such as malignant peripheral nerve sheath tumors, malignant schwannomas, neurofibrosarcomas, fibrosarcomas, synovial sarcomas, malignant fibrous histiocytoma (MFH) hemangiosarcomas, lymphangiosarcomas, gastrointestinal stromal tumors, alveolar soft part sarcoma, dermatofibrosarcoma protuberans (DFSP), desmoplastic small round cell tumour, epithelioid sarcoma, extra skeletal myxoid chondrosarcoma, and giant cell fibroblastoma (GCF).

The chlorotoxin conjugates described herein can be used for detection and treatment of tumors present in any organ and in any anatomical location, including but not limited to, breast, lung, brain, colon, rectum, prostate, head, neck, stomach, anus, and/or vaginal tissues, for example. Tumors of any grade or stage known to one of skill in the art, including low-grade tumors, are often detected by the chlorotoxin conjugates described herein. In some aspects, tumor detection includes imaging, resection, diagnostics and treatment.

In certain aspects, the present compounds are capable of passing across the blood brain barrier. Passing across the blood brain barrier is advantageous when detecting or treating a cancer cell in the brain, such as for example, a glioma cell or a brain tumor.

In some aspects, the dose of chlorotoxin conjugate is administered such that a threshold amount of chlorotoxin conjugate is achieved in the subject. For example, the threshold amount often depends upon the patient's age, weight, height, sex, general medical condition and previous medical history. For another example, the threshold amount does not depend upon the patient's age, weight, height, sex, general medical condition and previous medical history.

Other dosage forms is devised by those skilled in the art, as shown, for example, by Ansel and Popovich, Pharmaceutical Dosage Forms and Drug Delivery Systems, 5th Edition (Lea & Febiger 1990), Gennaro (ed.), Remington's Pharmaceutical Sciences, 19th Edition (Mack Publishing Company 1995), and by Ranade and Hollinger, Drug Delivery Systems (CRC Press 1996).

As an illustration, pharmaceutical compositions are often supplied as a kit comprising a container that comprises a chlorotoxin conjugate. Chlorotoxin conjugates are often provided in the form of an injectable solution for single or multiple doses, or as a sterile powder that will be reconstituted before injection. Alternatively, such a kit often includes a dry-powder disperser, liquid aerosol generator, or nebulizer for administration of a therapeutic conjugate. Such a kit further comprises written information on indications and usage of the pharmaceutical composition.

Methods of Tumor Prevention, Detection and Treatment

Subjects include, but are not limited to humans, non-human primates, monkeys, cows, dogs, rabbits, pigs, guinea pigs, rats, mice and zebrafish.

A sample includes any sample isolated from a subject, for example but not limited to, blood, serum, plasma, circulating cells, urine, saliva, and/or tissue removed from the body such as in a biopsy. Samples are often prepared using methods known to those of ordinary skill in the art, for example, blood samples are collected and incubated at room temperature for about 0.5 hours up to 2 hours prior to centrifugation, serum removal and storage at at least about 20° C., but more often −70° C.

Additional tests are often performed using samples from subjects, including complete blood counts, serum chemistry profiles and urinalysis.

The present disclosure provides methods for treating a disease or condition treatable by administering chlorotoxin. In one embodiment, the method includes administering an effective amount of a modified chlorotoxin peptide of the invention to a subject in need thereof.

The term "effective amount," as used herein, refers to a sufficient amount of an agent or a compound being administered which will relieve to some extent one or more of the symptoms of the disease or condition being treated. The result can be reduction and/or alleviation of the signs, symptoms, or causes of a disease, or any other desired alteration of a biological system. Compositions containing such agents or compounds can be administered for prophylactic, enhancing, and therapeutic treatments. An appropriate "effective" amount in any individual case may be determined using techniques, such as a dose escalation study.

In one embodiment, the invention provides a method for treating a cancer that expresses chlorotoxin binding sites in a patient, comprising administering to a patient in need thereof an effective amount of a chlorotoxin variant of the invention.

In one embodiment, the invention provides a method for treating a cancer that expresses chlorotoxin binding sites, comprising administering to a patient in need thereof an effective amount of a pharmaceutical composition comprising a chlorotoxin variant of the invention and a pharmaceutically acceptable carrier.

In one embodiment, the invention provides a method for treating a tumor expressing chlorotoxin binding sites, comprising administering to a patient in need thereof an effective amount of a chlorotoxin variant of the invention.

In one embodiment, the invention provides a method for inhibiting invasive activity of cells that express chlorotoxin binding sites, comprising administering an effective amount of a chlorotoxin variant to cells that express chlorotoxin binding sites.

The methods of treatment of the invention are applicable to human and animal subjects in need of such treatment.

Virtually every type of malignant cancer expressing chlorotoxin binding sites can be treated by the chlorotoxin variants and conjugates of the invention. These malignant cancers include gliomas, astrocytomas, medulloblastomas, choroid plexus carcinomas, ependymomas, meningioma, glioblastoma, ganglioma, pheochromocytoma, and metastatic brain tumors, other brain tumors, neuroblastoma, head and neck cancer, non-small cell lung cancer, small cell lung cancer, breast cancer, intestinal cancer, pancreatic cancer, colon cancer, liver cancer, kidney cancer, skin cancer, sarcomas (over 30 types), osteosarcoma, rhabdomyosarcoma, Ewing's sarcoma, carcinomas, melanomas, ovarian cancer, cervical cancer, lymphoma, thyroid cancer, anal cancer, colo-rectal cancer, endometrial cancer, germ cell tumors, laryngeal cancer, multiple myeloma, prostate cancer, retinoblastoma, gastric cancer, testicular cancer, and Wilm's tumor.

In certain aspects, the chlorotoxin conjugate is administered to an individual having or suspected of having a tumor, such that the conjugate binds specifically to the tumor. Such methods are useful in reducing the likelihood that the individual will develop a tumor, that one or more tumors in the individual will increase in size, that one or more tumors in the individual will metastasize, and/or that the cancer will progress by some other measure. As used herein, the term "metastasis" refers to the spread of tumor cells from one organ or tissue to another location, and also refers to tumor tissue that forms in a new location as a result of metastasis.

In some aspects, the chlorotoxin conjugate is useful for the treatment and/or diagnosis of neuroectodermal tumors such as gliomas, medulloblastomas, neuroblastomas, pheochromocytomas, melanomas, peripheral primitive neuroectodermal tumors, small cell carcinoma of the lung, Ewing's sarcoma, and metastatic tumors in the brain. In some aspects, the chlorotoxin conjugate is useful for the treatment and/or diagnosis of brain tumors, including but not limited to, glioma, including glioblastoma multiforme, anaplastic astrocytomas, low grade gliomas, pliocytic astrocytomas, oligodendrogliomas, gangliomas, meningiomas, and ependymomas.

In other aspects, the compounds of the present disclosure are used to detect and/or treat soft-tissue sarcomas. Soft-tissue sarcomas are a group of malignant tumors that form in fat, muscles, nerves, joints, and blood vessels. In 2012, it was estimated that approximately 11,280 Americans would be diagnosed with soft-tissue sarcomas and approximately 3,900 would be expected to die from soft-tissue sarcomas. Soft tissue and bone sarcoma incidence rates have increased slightly over the past 30 years; however, soft-tissue sarcoma is more deadly, possibly because the lack of specific symptoms at early disease stages may lead to delays in diagnosis.

Moreover, certain inherited disorders and past treatment with radiation therapy can increase the risk of soft-tissue sarcoma. No modifiable risk factors for sarcoma have been identified. Standard treatments for soft-tissue sarcoma include surgery, chemotherapy, and radiation therapy.

Since symptoms of soft-tissue sarcomas often do not appear until the disease is advanced, only about 50% of soft-tissue sarcomas are found in the early stages, before they have spread.

The present invention provides such methods of detection, imaging, visualization, analysis and treatment for these and other uses that should be apparent to those skilled in the art from the teachings herein.

The present invention is based in part upon the identification by the inventors that soft-tissue sarcomas have a high level of uptake of the conjugate compared to other tumors or normal tissues and are particularly well-suited for detection by means of administering a chlorotoxin conjugated to a labeling agent for detection, visualization, imaging, or analysis. Such visualization can be during or related to surgical (intraoperative) resection or during or related to initial identification of the sarcoma or during or related to monitoring of the sarcoma relevant to treatment.

Real-time intraoperative visualization of solid tumors enables more complete resection while sparing surrounding normal tissue. Improvement in intraoperative tumor visualization would be of benefit for any resectable solid tumor, as it would enable surgeons to better determine the extent of local invasion as well as the presence of metastatic spread in nearby lymph nodes and fatty tissue. This kind of information would be helpful in making surgical decisions, for example, decisions regarding which patients would respond well to limb-sparing approaches in the treatment of sarcomas.

For brain tumors this is of paramount importance, since removal of additional tissue can unnecessarily increase cognitive and functional impairment, yet being too conservative in the amount of resection may leave tumor tissue behind.

Surgeons who specialize in human breast cancer surgery have indicated that precise margins are less important in this indication, and the surgical approach is generally a wide excision with 0.2-1 cm margins on all sides. It is difficult for surgeons to obtain wide margins using only white light and preoperative imaging information. In 20-50% of breast cancer surgeries, failure to obtain clean margins leads to second surgeries.

The present invention shows that soft-tissue sarcomas are particularly identifiable when bound by a chlorotoxin conjugate, which can be effectively used to detect these sarcomas, especially during or related to surgery and intraoperative resection. For example, the chlorotoxin conjugate can be used alone or on combination with other detection agents, to detect, image, visualize, or analyze the tumor in advance of, during, or following anti-tumor treatments, which can include surgery and surgical resection, chemotherapy, radiation therapy, and immunotherapy. In addition, the chlorotoxin conjugate can be used alone or with other detection agents for follow-up monitoring post treatment as well as for general monitoring for full-body screening.

Low-grade tumors generally tend to be slow growing, slower to spread, and often have better prognosis than higher-grade tumors, making them more curable with surgical resection than high-grade tumors, which may need more systemic treatment. The inventors show that use of a chlorotoxin conjugated to a labeling agent can be particularly effective in detection, imaging, visualization, or analysis of low-grade tumors, such as meningiomas, allowing their complete resection before they metastasize or spread.

Intraoperative resection of tumor types may vary depending on the anatomic location and type of tumor. For example, when a tumor is located in brain tissue, the surgeon is likely to require perfect or near perfect specificity between a tumor imaging or detection agent and the tumor tissue so that only diseased tissue is resected. On the other hand, when the tumor is located in a tissue where wider margins are generally resected, such as breast or mammary cancer or colon cancer, or in cancers where the tumor is likely to spread locally, such as squamous cell carcinoma, it would be advantageous for a surgeon to be able to use a tumor imaging or detection agent to identify peritumoral tissue that is likely to become tumor tissue.

Soft-tissue sarcomas can develop from soft tissues like fat, muscle, nerves, fibrous tissues, blood vessels, or deep skin tissues. They can be found in any part of the body. Most of them develop in the arms or legs. They can also be found in the trunk, head and neck area, internal organs, and the area in back of the abdominal cavity (known as the retroperitoneum).

Soft-tissue sarcomas that may be amenable to detection with a chlorotoxin conjugate of the present invention include, but are not limited to: fat tissue tumors, muscle tissue tumors, skeletal muscle sarcomas, rhabdomyosarcomas, peripheral nerve tumors, fibrous tissue tumors, myxofibrosarcomas, fibromatosis, joint tissue tumors, tumors of blood vessels and lymph vessels, angiosarcomas, gastrointestinal stromal tumors, alveolar soft part sarcoma, dermatofibrosarcoma protuberans (DFSP), desmoplastic small round cell tumour, epithelioid sarcoma, extra skeletal myxoid chondrosarcoma, and giant cell fibroblastoma (GCF).

Sarcomas that start in the body's fat cells are called liposarcomas. They can grow anywhere in the body and most commonly affect people aged 50-65 years. Some grow very slowly, taking many years to develop, whereas others grow more quickly.

Muscle tissue sarcomas include smooth muscle sarcomas and skeletal muscle sarcomas. Smooth muscle forms the walls of internal organs such as the stomach, intestine, womb (uterus), and blood vessels. The muscle causes these organs to contract, which happens without our control. Smooth muscle is also called involuntary muscle. Sarcomas that develop in smooth muscle are called leiomyosarcomas. They are one of the more common types of sarcoma and can occur anywhere in the body, especially in the back of the abdominal area (retroperitoneum). Leiomyosarcomas are less often found in the deep, soft tissues of the legs or arms. They tend to occur in adults, particularly in the elderly. Skeletal muscles are the active muscles in our arms and legs or other parts of the body that we control. They are voluntary muscles and sometimes called striated muscles because the cells look stripy when examined under a microscope.

Sarcomas that grow in the voluntary muscles of the body are called rhabdomyosarcomas. They are found mostly in the head and neck, but also in organs such as the bladder, vagina and the arms or legs. Rhabdomyosarcomas are more commonly diagnosed in children than in adults.

Peripheral nerve tumors can be found in the peripheral nervous system, which consists of all the nerves that run throughout the body. Sarcomas of the peripheral nerves develop in the cells that cover the nerves. They're known as malignant peripheral nerve sheath tumors (MPNST) and can occur anywhere in the body. There are different types of MPNSTs, including malignant schwannomas and neurofibrosarcomas. They most commonly occur in people who have a rare genetic disorder called neurofibromatosis (von Recklinghausen's disease).

Fibrous tissue tumors occur in tissues that join muscles to bones. This tissue is made up of cells called fibrocytes. A sarcoma of the fibrous tissue is called a fibrosarcoma. They are most commonly found on the arms, legs or trunk, but can occur deeper in the body. They can occur at any age but are more commonly seen in people aged 20-60 years. Most people first notice them as a painless, firm lump.

Soft-tissue sarcomas that develop very close to the body's joints are known as synovial sarcomas. They commonly develop near, but not inside, joints such as the knee or elbow, but they can occur in any part of the body. They usually appear as hard lumps and are more common in children and young adults.

Blood and lymph vessel tumors include sarcomas that start from the cells that make up the walls of blood or lymph vessels and are called angiosarcomas. Haemangiosarcomas develop from blood vessels and lymphangiosarcomas develop from the lymph vessels.

Angiosarcomas are sarcomas that sometimes occur in a part of the body that has been treated with radiotherapy many years before.

Gastrointestinal stromal tumors (GIST) are soft-tissue sarcomas that develop in nerve cells in the walls of the digestive system.

The inventors have also identified that low-grade tumors can be detected with a chlorotoxin conjugated to a labeling agent. This is particularly useful since low-grade tumors have a better prognosis if they can be fully resected.

In addition, the invention is based in part on the identification by the inventors of an optimal dose for tumor imaging in dogs of at least about 0.8 mg/m$^2$. One skilled in the art will recognize that dosage for the chlorotoxin conjugate will be determined based on the amount of conjugate administered and the amount of time after administration after which the imaging is performed. In some aspects the optimal dose for tumor imaging is in the range of about 0.85 mg/m$^2$ to about 1.2 mg/m$^2$, or in the range of about 0.9 to about 1.1 mg/m$^2$. At doses up to 0.9 mg/m$^2$, signal in gross tumor samples increases as a function of dose. At doses above 0.9 mg/m$^2$, the correlation between signal and dose is lost, suggesting that in this model system the signal in tumor is maximal above this dose. However, it is recognized that in other cases more conjugate can be administered with acceptable imaging. Thus, in some aspects, the amount of chlorotoxin conjugate that can be administered can be in the range of about 1.3 mg/m$^2$ to about 2.5 mg/m$^2$, or in the range of about 2.6 mg/m$^2$ to about 3.5 mg/m$^2$, or in the range of about 3.6 mg/m$^2$ to about 4.5 mg/m$^2$, or in the range of about 4.6 mg/m$^2$ to about 5.5 mg/m$^2$, or upwards of 5.5 mg/m$^2$.

Imaging Methods

In a further aspect of the invention, methods of using the chlorotoxin conjugates are provided. In one embodiment, the invention provides a method for imaging a tissue imagable by chlorotoxin. In the method, a tissue imagable by chlorotoxin is contacted with a chlorotoxin conjugate. In one embodiment, the imaging method is a fluorescence imaging method. Representative methods for making and using fluorescent chlorotoxin conjugates are described in U.S. Patent Application Publication No. 20080279780 A1, Fluorescent Chlorotoxin Conjugate and Method for Intra-Operative Visualization of Cancer, and in U.S. Patent Application Publication No. 20130195760, Chlorotoxin Variants, Conjugates, And Methods For Their Use, both of which are expressly incorporated herein by reference in their entirety.

In many cases, chlorotoxin conjugates can be administered to human and animal subjects, such as with a pharmaceutically acceptable carrier. In some aspects, the composition includes a pharmacologically effective amount of a modified chlorotoxin conjugate. An effective amount can be routinely determined by established procedures. An effective amount is an amount sufficient to occupy chlorotoxin binding sites in cancer cells, but low enough to minimize non-specific binding to non-neoplastic tissues. An effective amount optimizes signal-to-noise ratio for intra-operative imaging.

The disclosure provides methods for detecting a tissue using the chlorotoxin conjugates. The chlorotoxin conjugates of the invention target and are bound by chlorotoxin binding sites. It will be appreciated that chlorotoxin binding sites may take two forms: sites that bind chlorotoxin and sites that bind the chlorotoxin conjugates of the invention. It will be appreciated that chlorotoxin binding sites may be distinct from chlorotoxin conjugate binding sites.

In some aspects, a method for differentiating foci of cancers that express chlorotoxin binding sites from non-neoplastic tissue is provided. The method includes contacting a tissue of interest with a chlorotoxin conjugate having affinity and specificity for cells that express chlorotoxin binding sites, wherein the chlorotoxin conjugate comprises one or more red or near infrared emitting fluorescent moieties covalently coupled to a chlorotoxin, and measuring the level of binding of the chlorotoxin conjugate, wherein an elevated level of binding, relative to normal tissue, is indicative that the tissue is neoplastic.

In some aspects, a method for detecting cancers that express chlorotoxin binding sites is provided. The method includes the steps of contacting a tissue of interest with a chlorotoxin conjugate having affinity and specificity for cells that express chlorotoxin binding sites, wherein the chlorotoxin conjugate comprises one or more red or near infrared emitting fluorescent moieties covalently coupled to a chlorotoxin, and measuring the level of binding of the chlorotoxin conjugate, wherein an elevated level of binding, relative to normal tissue, is indicative that the tissue is neoplastic.

In some aspects, a method for determining the location of cancer cells that express chlorotoxin binding sites in a patient intra-operatively is provided. The method includes the steps of administering a pharmaceutical composition to a patient, wherein the pharmaceutical composition comprises a pharmaceutically acceptable carrier and an amount of a chlorotoxin conjugate sufficient to image cancer cells that express chlorotoxin binding sites in vivo, wherein the chlorotoxin conjugate comprises one or more red or near infrared emitting fluorescent moieties covalently coupled to a chlorotoxin, measuring the level of binding of the chlorotoxin conjugate by fluorescence imaging to determine the location of cancer cells that express chlorotoxin binding sites, wherein an elevated level of binding, relative to normal tissue, is indicative of the presence of cancer cells that express chlorotoxin binding sites; and surgically removing from the patient at least some cells that express chlorotoxin binding sites located by fluorescence imaging.

Imaging methods for detection of cancer foci disclosed herein are applicable to mouse and other animal models of cancer as well as to veterinary practice.

The present invention provides methods for intraoperative imaging and resection of tumors with a chlorotoxin conjugates detectable by fluorescence imaging that allows for intraoperative visualization of cancerous tissues, compositions that include the chlorotoxin conjugate, and methods for using the chlorotoxin conjugate. The chlorotoxin is a targeting agent that directs the conjugate to a tissue of interest. In one embodiment, the chlorotoxin conjugate of the invention includes one or more labeling agents. In a further embodiment, the labeling agent comprises a fluorescent moiety (e.g., red or near infrared emitting fluorescent moieties) covalently coupled to the chlorotoxin. In another embodiment, the labeling agent comprises a radionuclide.

As used herein, the term "red or near infrared emitting fluorescent moiety" refers to a fluorescent moiety having a fluorescence emission maximum greater than about 600 nm.

In certain embodiments of the chlorotoxin conjugate, the fluorescent moieties are derived from fluorescent compounds characterized by emission wavelength maxima greater than about 600 nm to avoid autofluorescence, emission that travels through millimeters to one centimeter of tissue/blood/fluids, emission that is not absorbed by hemoglobin, other blood components, or proteins in human or animal tissue. In some aspects, the emission wavelength maximum is greater than 600 nm, greater than 650 nm, greater than 700 nm, greater than 750 nm, greater than 800 nm, greater than 850 nm, greater than 900 nm, or greater than 950 nm.

The fluorescent moiety is covalently coupled to the chlorotoxin to allow for the visualization of the conjugate by fluorescence imaging. The fluorescent moiety is derived from a fluorescent compound. Suitable fluorescent compounds are those that can be covalently coupled to a chlorotoxin without substantially adversely affecting the targeting and binding function of the chlorotoxin conjugate. Similarly, suitable fluorescent compounds retain their fluorescent properties after conjugation to the chlorotoxin.

Generally, the dosage of administered chlorotoxin conjugates may vary depending upon such factors as the patient's age, weight, height, sex, general medical condition and previous medical history. Typically, it is desirable to provide the recipient with a dosage of chlorotoxin conjugated to a chemotherapeutic, an anti-cancer agent, or an anti-cancer drug that is effective to achieve inhibition, shrinkage, killing, minimization, or prevention of metastasis. In many cases, it is desirable to provide the recipient with a dosage of a chlorotoxin conjugate that is in the range of from about 3 mg to about 6 mg, although a lower or higher dosage also may be administered as circumstances dictate.

Administration of a chlorotoxin conjugate to a subject can be topical, inhalant, intravenous, intraarterial, intraperitoneal, intramuscular, subcutaneous, intrapleural, intrathecal, by perfusion through a regional catheter, or by direct intralesional injection. When administering conjugates by injection, the administration may be by continuous infusion or by single or multiple boluses.

Additional routes of administration include oral, mucosal-membrane, pulmonary, and transcutaneous. Oral delivery is suitable for polyester microspheres, zein microspheres, proteinoid microspheres, polycyanoacrylate microspheres, and lipid-based systems (see, for example, DiBase and Morrel, "Oral Delivery of Microencapsulated Proteins," in Protein Delivery: Physical Systems, Sanders and Hendren (eds.), pages 255-288 (Plenum Press 1997)). The feasibility of an intranasal delivery is exemplified by such a mode of insulin administration (see, for example, Hinchcliffe and Ilium, Adv. Drug Deliv. Rev. 35:199 (1999)). Dry or liquid particles comprising a chlorotoxin conjugate can be prepared and inhaled with the aid of dry-powder dispersers, liquid aerosol generators, or nebulizers (e.g., Pettit and Gombotz, TIBTECH 16:343 (1998); Patton et al., Adv. Drug Deliv. Rev. 35:235 (1999)). This approach is illustrated by the AERX diabetes management system, which is a hand-held electronic inhaler that delivers aerosolized insulin into the lungs. Transdermal delivery using electroporation provides another means to administer a chlorotoxin conjugate.

A pharmaceutical composition comprising a chlorotoxin conjugate can be formulated according to known methods to prepare pharmaceutically useful compositions, whereby the conjugate is combined with a pharmaceutically acceptable carrier. A composition is said to be a "pharmaceutically acceptable carrier" if its administration can be tolerated by a recipient patient. Sterile phosphate-buffered saline is one example of a pharmaceutically acceptable carrier. Other suitable carriers are well-known to those in the art. See, for example, Gennaro (ed.), Remington's Pharmaceutical Sciences, 19th Edition (Mack Publishing Company 1995).

A pharmaceutical composition comprising a chlorotoxin conjugate can be furnished in liquid form, in an aerosol, or in solid form. Liquid forms, are illustrated by injectable solutions, aerosols, droplets, topological solutions and oral suspensions. Exemplary solid forms include capsules, tablets, and controlled-release forms. The latter form is illustrated by miniosmotic pumps and implants (Bremer et al., Pharm. Biotechnol. 10:239 (1997); Ranade, "Implants in Drug Delivery," in Drug Delivery Systems, Ranade and Hollinger (eds.), pages 95-123 (CRC Press 1995); Bremer et al., "Protein Delivery with Infusion Pumps," in Protein Delivery: Physical Systems, Sanders and Hendren (eds.), pages 239-254 (Plenum Press 1997); Yewey et al., "Delivery of Proteins from a Controlled Release Injectable Implant," in Protein Delivery Physical Systems, Sanders and Hendren (eds.), pages 93-117 (Plenum Press 1997)). Other solid forms include creams, pastes, other topological applications, and the like.

Other dosage forms can be devised by those skilled in the art, as shown, for example, by Ansel and Popovich, Pharmaceutical Dosage Forms and Drug Delivery Systems, 5.sup.th Edition (Lea & Febiger 1990), Gennaro (ed.), Remington's Pharmaceutical Sciences, 19.sup.th Edition (Mack Publishing Company 1995), and by Ranade and Hollinger, Drug Delivery Systems (CRC Press 1996).

As an illustration, pharmaceutical compositions may be supplied as a kit comprising a container that comprises a chlorotoxin conjugate. Therapeutic conjugates can be provided in the form of an injectable solution for single or multiple doses, or as a sterile powder that will be reconstituted before injection. Alternatively, such a kit can include a dry-powder disperser, liquid aerosol generator, or nebulizer for administration of a therapeutic conjugate. Such a kit may further comprise written information on indications and usage of the pharmaceutical composition.

Various references, including patent applications, patents, and scientific publications, are cited herein, the disclosures of each of which is incorporated herein by reference in its entirety.

The present invention is not to be limited in scope by the specific embodiments described herein. Indeed, various modifications of the invention in addition to those described herein will become apparent to those skilled in the art from the foregoing description and accompanying figures. Such modifications are intended to fall within the scope of the appended claims.

All features discussed in connection with any aspect or embodiment herein can be readily adapted for use in other aspects and embodiments herein. The use of different terms or reference numerals for similar features in different embodiments does not necessarily imply differences other than those expressly set forth. Accordingly, the present invention is intended to be described solely by reference to the appended claims, and not limited to the embodiments disclosed herein.

Unless otherwise specified, the presently described methods and processes can be performed in any order. For example, a method describing steps (a), (b), and (c) can be performed with step (a) first, followed by step (b), and then step (c). Or, the method can be performed in a different order such as, for example, with step (b) first followed by step (c) and then step (a). Furthermore, those steps can be performed simultaneously or separately unless otherwise specified with particularity.

The particulars shown herein are by way of example and for purposes of illustrative discussion of the preferred embodiments of the present invention only and are presented in the cause of providing what is believed to be the most useful and readily understood description of the principles and conceptual aspects of various embodiments of the invention. In this regard, no attempt is made to show structural details of the invention in more detail than is necessary for the fundamental understanding of the invention, the description taken with the drawings and/or examples making apparent to those skilled in the art how the several forms of the invention may be embodied in practice.

Where a range of values is provided, it is understood that each intervening value, to the tenth of the unit of the lower limit unless the context clearly dictates otherwise, between the upper and lower limit of that range, and any other stated or intervening value in that stated range, is encompassed within the disclosure provided herein. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the disclosure provided herein.

All features discussed in connection with an aspect or embodiment herein can be readily adapted for use in other aspects and embodiments herein. The use of different terms or reference numerals for similar features in different embodiments does not necessarily imply differences other than those expressly set forth. Accordingly, the present invention is intended to be described solely by reference to the appended claims, and not limited to the embodiments disclosed herein.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

NUMBERED EMBODIMENTS

The following embodiments recite non-limiting permutations of combinations of feature disclosed herein. Other permutations of combinations of features are also contemplated. In particular, each of these numbered embodiments is contemplated as depending from or relating to every previous or subsequent numbered embodiment. 1. A peptide active agent conjugate, comprising: a) a peptide, wherein the peptide comprises a sequence that has at least 70% sequence identity with any one of SEQ ID NO: 508-SEQ ID NO: 758 and upon administration to a subject the peptide homes, targets, migrates to, accumulates in, binds to, is retained by, or is directed to a cartilage of the subject, and an active agent selected from an active agent class selected from TABLE 53 or TABLE 55; b) a peptide, wherein the peptide comprises a sequence that has at least 70% sequence identity with any one of SEQ ID NO: 508-SEQ ID NO: 758 and upon administration to a subject the peptide homes, targets, migrates to, accumulates in, binds to, is retained by, or is directed to a kidney of the subject, and an active agent selected from an active agent class selected from TABLE 54 or TABLE 55; c) a peptide, wherein the peptide comprises a sequence that has at least 70% sequence identity with any one of SEQ ID NO: 508-SEQ ID NO: 758 and upon administration to a subject the peptide homes, targets, migrates to, accumulates in, binds to, is retained by, or is directed to a cartilage or kidney of the subject, and an active agent selected from TABLE 53, TABLE 54, or TABLE 55; d) a peptide, wherein the peptide comprises a sequence that has at least 70% sequence identity with any one of SEQ ID NO: 798-SEQ ID NO: 1048 and upon administration to a subject the peptide homes, targets, migrates to, accumulates in, binds to, is retained by, or is directed to a cartilage of the subject, and an active agent selected from TABLE 53 or TABLE 55; e) a peptide, wherein the peptide comprises a sequence that has at least 70% sequence identity with any one of SEQ ID NO: 798-SEQ ID NO: 1048 and upon administration to a subject the peptide homes, targets, migrates to, accumulates in, binds to, is retained by, or is directed to a kidney of the subject, and an active agent selected from an active agent class selected from TABLE 54 or TABLE 55; f) a peptide, wherein the peptide comprises a sequence that has at least 70% sequence identity with any one of SEQ ID NO: 798-SEQ ID NO: 1048 and upon administration to a subject the peptide homes, targets, migrates to, accumulates in, binds to, is retained by, or is directed to a cartilage or kidney of the subject, and an active agent selected from an active agent class selected from TABLE 53, TABLE 54, or TABLE 55; g) a peptide, wherein the peptide comprises a sequence that has at least 70% sequence identity with any one of SEQ ID NO: 744-SEQ ID NO: 758 and upon administration to a subject the peptide homes, targets, migrates to, accumulates in, binds to, is retained by, or is directed to a cartilage of the subject, and an active agent selected from TABLE 53, TABLE 55, or TABLE 56; h) a peptide, wherein the peptide comprises a sequence that has at least 70% sequence identity with any one of SEQ ID NO: 744-SEQ ID NO: 758 and upon administration to a subject the peptide homes, targets, migrates to, accumulates in, binds to, is retained by, or is directed to a kidney of the subject, and an active agent selected from TABLE 54, TABLE 55, or TABLE 56; i) a peptide, wherein the peptide comprises a sequence that has at least 70% sequence identity with any one of SEQ ID NO: 744-SEQ ID NO: 758 and upon administration to a subject the peptide homes, targets, migrates to, accumulates in, binds to, is retained by, or is directed to a cartilage or a kidney of the subject, and an active agent selected from TABLE 53, TABLE 54, TABLE 55, or TABLE 56; j) a peptide, wherein the peptide comprises a sequence that has at least 70% sequence identity with any one of SEQ ID NO: 1034-SEQ ID NO: 1048 and upon administration to a subject the peptide homes, targets, migrates to, accumulates in, binds to, is retained by, or is directed to a cartilage of the subject, and an active agent selected from TABLE 53, TABLE 55, or TABLE 56; k) a peptide, wherein the peptide comprises a sequence that has at least 70% sequence identity with any one of SEQ ID NO: 1034-SEQ ID NO: 1048 and upon administration to a subject the peptide homes, targets, migrates to, accumulates in, binds to, is retained by, or is directed to a kidney of the subject, and an active agent selected from TABLE 54, TABLE 55, or TABLE 56; or l) a peptide, wherein the peptide comprises a sequence that has at least 70% sequence identity with any one of SEQ ID NO: 1034-SEQ ID NO: 1048 and upon administration to a subject the peptide homes, targets, migrates to, accumulates in, binds to, is retained by, or is directed to a cartilage or a kidney of the subject, and an active agent selected from TABLE 53, TABLE 54, TABLE 55, or TABLE 56. 2. The peptide active agent conjugate of embodiment 1, wherein the peptide comprises: a) a sequence that has at least 75%, at least 80%, at least 85%, at least 90%, at least 95%, at least 97%, at least 99% or 100% sequence identity with any one of SEQ ID NO: 508-SEQ ID NO: 758 or a fragment thereof; b) a sequence that has at least 75%, at least 80%, at least 85%, at least 90%, at least 95%, at least 97%, at least 99% or 100% sequence identity with any one of SEQ ID NO: 744-SEQ ID NO: 758 or a fragment thereof; c) a sequence that has at least 75%, at least 80%, at least 85%, at least 90%, at least 95%, at least 97%, at least 99% or 100% sequence identity with any one of SEQ ID NO: 798-SEQ ID NO: 1048 or a fragment thereof; or d) a sequence that has at least 75%, at least 80%, at least 85%, at least 90%, at least 95%, at least 97%, at least 99% or 100% sequence identity with any one of SEQ ID NO: 1034-SEQ ID NO: 1048 or a fragment thereof. 3. The peptide active agent conjugate of any one of embodiments 1-2, wherein the peptide comprises: a) a sequence of any one of SEQ ID NO: 508-SEQ ID NO: 758 or a fragment thereof; b) a sequence of any one of SEQ ID NO: 744-SEQ ID NO: 758 or a fragment thereof; c) a sequence of any one of SEQ ID NO: 798-SEQ ID NO: 1048 or a fragment thereof; or d) a sequence of any one of SEQ ID NO: 1034-SEQ ID NO: 1048 or a fragment thereof. 4. A peptide comprising a sequence that has at least 70%, at least 75%, at least 80%, at least 85%, at least 90%, at least 95%, at least 97%, at least 99%, or 100% sequence identity with any one of SEQ ID NO: 744-SEQ ID NO: 758 or at least 70%, at least 75%, at least 80%, at least 85%, at least 90%, at least 95%, at least 97%, at least 99%, or 100% sequence identity with any one of SEQ ID NO: 1034-SEQ ID NO: 1048. 5. The peptide active agent conjugate of any one of embodiments 1-3 or the peptide of embodiment 4, wherein the peptide comprises: a) a sequence of any one of SEQ ID NO: 485-SEQ ID NO: 507 or a fragment thereof; b) a sequence of any one of SEQ ID NO: 759-SEQ ID NO: 781 or a fragment thereof; c) a sequence of any one of SEQ ID NO: 505-SEQ ID NO: 507 or a fragment thereof; or d) a sequence of any one of SEQ ID NO: 779-SEQ ID NO: 781 or a fragment thereof. 6. The peptide active agent conjugate of any one of embodiments 1-3 or 5, or the peptide of any one of embodiments 4-5, wherein the peptide is at least 30%, at least 40%, at least 50%, at least 60%, at least 70%, at least 80%, at least 90%, at least 95%, at least, 97%, at least 98%, or at least 99% identical to any one of SEQ ID NO: 978-SEQ ID NO: 1024 or at least 30%, at least 40%, at least 50%, at least 60%, at least 70%, at least 80%, at least 90%, at least 95%, at least 97%, at least 98%, or at least 99% identical to any one of SEQ ID NO: 688-SEQ ID NO: 734. 7. The peptide active agent conjugate of any one of embodiments 1-3 or 5-6 or the peptide of any one of embodiments 4-6, wherein the peptide is at least 70%, at least 80%, at least 90%, at least 95%, at least 97%, or 100% identical to: a) SEQ ID NO: 595; b) SEQ ID NO: 885; c) SEQ ID NO: 508; d) SEQ ID NO: 798; e) SEQ ID NO: 511; f) SEQ ID NO: 801; g) SEQ ID NO: 669; h) SEQ ID NO: 959; i) SEQ ID NO: 514; j) SEQ ID NO: 804; k) SEQ ID NO: 592; l) SEQ ID NO: 882; m) SEQ ID NO: 520; n) SEQ ID NO: 810; o) SEQ ID NO: 683; p) SEQ ID NO: 962; q) SEQ ID NO: 509; r) SEQ ID NO: 799; s) SEQ ID NO: 590; t) SEQ ID NO: 880; u) SEQ ID NO: 510; v) SEQ ID NO: 800; w) SEQ ID NO: 671; x) SEQ ID NO: 961; y) SEQ ID NO: 591; or z) SEQ ID NO: 881. 8. The peptide active agent conjugate of any one of embodiments 1-3 or 5-7 or the peptide of any one of embodiments 4-7, wherein the peptide is at least 70%, at least 80%, at least 90%, at least 95%, at least 97%, at least 99%, or 100% identical to: a) SEQ ID NO: 1034; b) SEQ ID NO: 1035; c) SEQ ID NO: 1036; d) SEQ ID NO: 1037; e) SEQ ID NO: 1038; f) SEQ ID NO: 1039; g) SEQ ID NO: 1040; h) SEQ ID NO: 1041; i) SEQ ID NO: 1042; j) SEQ ID NO: 1043; k) SEQ ID NO: 1044; l) SEQ ID NO: 1045; m) SEQ ID NO: 1046; n) SEQ ID NO: 1047; o) SEQ ID NO: 1048; p) SEQ ID NO: 744; q) SEQ ID NO: 745; r) SEQ ID NO: 746; s) SEQ ID NO: 747; t) SEQ ID NO: 748; u) SEQ ID NO: 749; v) SEQ ID NO: 750; w) SEQ ID NO: 751; x) SEQ ID NO: 752; y) SEQ ID NO: 753; z) SEQ ID NO: 754; aa) SEQ ID NO: 755; bb) SEQ ID NO: 756; cc) SEQ ID NO: 757; or dd) SEQ ID NO: 758. 9. The peptide active agent conjugate of any one of embodiments 1-3 or 5-8 or the peptide of any one of embodiments 4-8, wherein the peptide homes, targets, migrates to, accumulates in, binds to, is retained by, or is directed to cartilage, to kidney, or to cartilage and kidney. 10. The peptide active agent conjugate of any one of embodiments 1-3 or 5-9 or the peptide of any one of embodiments 4-9, wherein the peptide homes, targets, migrates to, accumulates in, binds to, is retained by, or is directed to proximal tubules of the kidney. 11. The peptide active agent conjugate of any one of embodiments 1-3 or 5-10 or the peptide of any one of embodiments 4-10, wherein the peptide is covalently conjugated to the active agent. 12. The peptide active agent conjugate of any one of embodiments 1-3 or 5-11, wherein the peptide active agent conjugate homes, targets, migrates to, accumulates in, binds to, is retained by, or is directed to a cartilage or a kidney of the subject. 13. The peptide active agent conjugate of any one of embodiments 1-3 or 5-12 or the peptide of any one of embodiments 4-12, wherein the peptide comprises 4 or more cysteine residues. 14. The peptide active agent conjugate of any one of embodiments 1-3 or 5-13 or the peptide of any one of embodiments 4-13, wherein the peptide comprises three or more disulfide bridges formed between cysteine residues, wherein one of the disulfide bridges passes through a loop formed by two other disulfide bridges. 15. The peptide active agent conjugate of any one of embodiments 1-3 or 5-14 or the peptide of any one of embodiments 4-14, wherein the peptide comprises a plurality of disulfide bridges formed between cysteine residues.

16. The peptide active agent conjugate of any one of embodiments 1-3 or 5-15 or the peptide of any one of embodiments 4-15, wherein the peptide comprises a disulfide through a disulfide knot. 17. The peptide active agent conjugate of any one of embodiments 1-3 or 5-16 or the peptide of any one of embodiments 4-16, wherein at least one amino acid residue of the peptide is in an L configuration or, wherein at least one amino acid residue of the peptide is in a D configuration. 18. The peptide active agent conjugate of any of embodiments 1-3 or 5-17 or the peptide of any one of embodiments 4-17, wherein the sequence comprises at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58 residues, at least 59, at least 60, at least 61, at least 62, at least 63, at least 64, at least 65, at least 66, at least 67, at least 68, at least 69, at least 70, at least 71, at least 72, at least 73, at least 74, at least 75, at least 76, at least 77, at least 78, at least 79, at least 80, or at least 81 residues. 19. The peptide active agent conjugate of any of embodiments 1-3 or 5-18 or the peptide of any one of embodiments 4-18, wherein any one or more K residues are replaced by an R residue or wherein any one or more R residues are replaced by for a K residue. 20. The peptide active agent conjugate of any of embodiments 1-3 or 5-19 or the peptide of any one of embodiments 4-19, wherein any one or more M residues are replaced by any one of the I, L, or V residues. 21. The peptide active agent conjugate of any of embodiments 1-3 or 5-20 or the peptide of any one of embodiments 4-20, wherein any one or more L residues are replaced by any one of the V, I, or M residues. 22. The peptide active agent conjugate of any of embodiments 1-3 or 5-21 or the peptide of any one of embodiments 4-21, wherein any one or more I residues are replaced by any of the M, L, or V residues. 23. The peptide active agent conjugate of any of embodiments 1-3 or 5-22 or the peptide of any one of embodiments 4-22, wherein any one or more V residues are replaced by any of the M, I, or L residues. 24. The peptide active agent conjugate of any of embodiments 1-3 or 5-23 or the peptide of any one of embodiments 4-23, wherein any one or more G residues are replaced by an A residue or wherein any one or more A residues are replaced by a G residue. 25. The peptide active agent conjugate of any of embodiments 1-3 or 5-24 or the peptide of any one of embodiments 4-24, wherein any one or more S residues are replaced by a T residue or wherein any one or more T residues are replaced by for an S residue. 26. The peptide active agent conjugate of any of embodiments 1-3 or 5-25 or the peptide of any one of embodiments 4-25, wherein any one or more Q residues are replaced by an N residue or wherein any one or more N residues are replaced by a Q residue. 27. The peptide active agent conjugate of any of embodiments 1-3 or 5-26 or the peptide of any one of embodiments 4-26, wherein any one or more D residues are replaced by an E residue or wherein any one or more E residues are replaced by a D residue. 28. The peptide active agent conjugate of any of any one of embodiments 1-3 or 5-27 or the peptide of any one of embodiments 4-27, wherein the peptide has a charge distribution comprising an acidic region and a basic region. 29. The peptide of embodiment 28, wherein the acidic region is a nub. 30. The peptide of embodiment 28, wherein the basic region is a patch. 31. The peptide active agent conjugate of any one of embodiments 1-3 or 5-30 or the peptide of any one of embodiments 4-30, wherein the peptide comprises 5-12 basic residues. 32. The peptide active agent conjugate of any one of embodiments 1-3 or 5-31 or the peptide of any one of embodiments 4-31, wherein the peptide comprises 0-5 acidic residues. 33. The peptide active agent conjugate of any of embodiments 1-3 or 5-32 or the peptide of any one of embodiments 4-32, wherein the peptide comprises 6 or more basic residues and 2 or fewer acidic residues. 34. The peptide active agent conjugate of any of embodiments 1-3 or 5-33 or the peptide of any one of embodiments 4-33, wherein the peptide comprises a 4-19 amino acid residue fragment containing at least 2 cysteine residues, and at least 2 positively charged amino acid residues. 35. The peptide active agent conjugate of any of embodiments 1-3 or 5-34 or the peptide of any one of embodiments 4-34, wherein the peptide comprises a 20-70 amino acid residue fragment containing at least 2 cysteine residues, no more than 2 basic residues and at least 2 positively charged amino acid residues. 36. The peptide active agent conjugate of any of embodiments 1-3 or 5-35 or the peptide of any one of embodiments 4-35, wherein the peptide comprises at least 3 positively charged amino acid residues. 37. The peptide active agent conjugate of any of embodiments 34-36 or the peptide of any one of embodiments 34-36, wherein the positively charged amino acid residues are selected from K, R, or a combination thereof. 38. The peptide active agent conjugate of any one of embodiments 1-3 or 5-37 or the peptide of any one of embodiments 4-37, wherein the peptide has a charge greater than 2 at physiological pH. 39. The peptide active agent conjugate of any one of embodiments 1-3 or 5-38 or the peptide of any one of embodiments 4-38, wherein the peptide has a charge greater than 3.5 at physiological pH. 40. The peptide active agent conjugate of any one of embodiments 1-3 or 5-39 or the peptide of any one of embodiments 4-39, wherein the peptide has a charge greater than 4.5 at physiological pH. 41. The peptide active agent conjugate of any one of embodiments 1-3 or 5-40 or the peptide of any one of embodiments 4-40, wherein the peptide has a charge greater than 5.5 at physiological pH. 42. The peptide active agent conjugate of any one of embodiments 1-3 or 5-41 or the peptide of any one of embodiments 4-41, wherein the peptide has a charge greater than 6.5 at physiological pH. 43. The peptide active agent conjugate of any one of embodiments 1-3 or 5-42 or the peptide of any one of embodiments 4-42, wherein the peptide has a charge greater than 7.5 at physiological pH. 44. The peptide active agent conjugate of any one of embodiments 1-3 or 5-43 or the peptide of any one of embodiments 4-43, wherein the peptide has a charge greater than 8.5 at physiological pH. 45. The peptide active agent conjugate of any one of embodiments 1-3 or 5-44 or the peptide of any one of embodiments 4-44, wherein the peptide has a charge greater than 9.5 at physiological pH. 46. The peptide active agent conjugate of any one of embodiments 1-3 or 5-45 or the peptide of any one of embodiments 4-45, wherein the peptide is selected from a potassium channel agonist, a potassium channel antagonist, a portion of a potassium channel, a sodium channel agonist, a sodium channel antagonist, a calcium channel agonist, a calcium channel antagonist, a hadrucalcin, a theraphotoxin, a huwentoxin, a kaliotoxin, a cobatoxin, or a lectin. 47. The peptide active agent conjugate of embodiment 46 or peptide of embodiment 46, wherein the lectin is SHL-Ib2. 48. The peptide active agent conjugate of any one of embodiments 1-3 or 5-47 or the peptide of any one of embodiments 4-47, wherein the peptide is arranged in a multimeric structure with at least one other peptide. 49. The peptide active agent conjugate of any one of embodiments 1-3 or 5-48 or the peptide of any one of embodiments 4-48, wherein at least one residue of the peptide comprises a chemical modification. 50. The peptide active agent conjugate of embodiment 49 or the peptide of embodiment 49, wherein the chemical modification is blocking the N-terminus of the peptide. 51. The peptide active agent conjugate of embodiment 49 or the peptide of embodiment 49, wherein the chemical modification is methylation, acetylation, or acylation. 52. The peptide active agent conjugate of embodiment 49 or the peptide of embodiment 49, wherein the chemical modification is: methylation of one or more lysine residues or analogue thereof; methylation of the N-terminus; or methylation of one or more lysine residue or analogue thereof and methylation of the N-terminus. 53. The peptide active agent conjugate of any one of embodiments 1-3 or 5-52 or the peptide of any one of embodiments 4-52, wherein the peptide is linked to an acyl adduct. 54. The peptide active agent conjugate of any one of embodiments 1-3 or 5-53 or the peptide of any one of embodiments 4-53, wherein the peptide is linked to an active agent. 55. The peptide active agent conjugate of embodiment 54, wherein the active agent is fused with the peptide at an N-terminus or a C-terminus of the peptide. 56. The peptide active agent conjugate of embodiment 55, wherein the active agent is another peptide. 57. The peptide active agent conjugate of embodiment 56, wherein the active agent is an antibody. 58. The peptide active agent conjugate of embodiment 56, wherein the active agent is an Fc domain, Fab domain, scFv, or Fv fragment. 59. The peptide active agent conjugate of any one of embodiments 55-58, wherein the peptide fused with an Fc domain comprises a contiguous sequence. 60. The peptide active agent conjugate of any one of embodiments 1-3 or 5-59 or the peptide of any one of embodiments 4-59, wherein 1, 2, 3, 4, 5, 6, 7, 8, 9, or 10 active agents are linked to the peptide. 61. The peptide active agent conjugate of any one of embodiments 1-3 or 5-60, wherein the peptide is linked to the active agent at an N-terminus, at the epsilon amine of an internal lysine residue, at the carboxylic acid of an aspartic acid or glutamic acid residue, or a C-terminus of the peptide by a linker. 62. The peptide active agent conjugate of any one of embodiments 1-3 or 5-61, wherein the peptide is linked to the active agent via a cleavable linker. 63. The peptide active agent conjugate of any one of embodiments 1-3 or 5-62 or the peptide of any one of embodiments 4-62 further comprising a non-natural amino acid, wherein the non-natural amino acid is an insertion, appendage, or substitution for another amino acid. 64. The peptide active agent conjugate of embodiment 63 or peptide of embodiment 63, wherein the peptide is linked to the active agent at the non-natural amino acid by a linker. 65. The peptide active agent conjugate of any one of embodiments 1-3 or 5-64, wherein the linker comprises an amide bond, an ester bond, a carbamate bond, a carbonate bond, a hydrazone bond, an oxime bond, a disulfide bond, a thioester bond, a thioether bond, a triazole, a carbon-carbon bond, or a carbon-nitrogen bond. 66. The peptide active agent conjugate of embodiment 62, wherein the cleavable linker comprises a cleavage site for matrix metalloproteinases, thrombin, cathepsins, or beta-glucuronidase. 67. The peptide active agent conjugate of any one of embodiments 61-66, wherein the linker is a hydrolytically labile linker. 68. The peptide active agent conjugate of any one of embodiments 61-67, wherein the linker is pH sensitive, reducible, glutathione-sensitive, or protease cleavable. 69. The peptide active agent conjugate of any one of embodiments 1-3 or 5-68, wherein the peptide is linked to the active agent via a stable linker. 70. The peptide active agent conjugate of any one of embodiments 1-3 or 5-69 or the peptide of any one of embodiments 4-69, wherein the peptide has an isoelectric point of about 9. 71. The peptide active agent conjugate of any one of embodiments 1-3 or 5-70 or peptide of any one of embodiments 4-70, wherein the peptide is linked to a detectable agent. 72. The peptide active agent conjugate or peptide of embodiment 71, wherein the detectable agent is fused with the peptide at an N-terminus or a C-terminus of the peptide. 73. The peptide active agent conjugate or peptide any one of embodiments 71-72, wherein 1, 2, 3, 4, 5, 6, 7, 8, 9, or 10 detectable agents are linked to the peptide. 74. The peptide active agent conjugate or peptide of any one of embodiments 71-73, wherein the peptide is linked to the detectable agent via a cleavable linker. 75. The peptide active agent conjugate or peptide of any one of embodiments 71-74, wherein the peptide is linked to the detectable agent at an N-terminus, at the epsilon amine of an internal lysine residue, or a C-terminus of the peptide by a linker. 76. The peptide active agent conjugate or peptide of any one of embodiments 71-75, further comprising a non-natural amino acid, wherein the non-natural amino acid is an insertion, appendage, or substitution for another amino acid. 77. The peptide active agent conjugate or peptide of embodiment 76, wherein the peptide is linked to the detectable agent at the non-natural amino acid by a linker. 78. The peptide active agent conjugate or peptide of any one of embodiments 71-77, wherein the linker comprises an amide bond, an ester bond, a carbamate bond, a hydrazone bond, an oxime bond, or a carbon-nitrogen bond. 79. The peptide active agent conjugate or peptide of embodiment 74, wherein the cleavable linker comprises a cleavage site for matrix metalloproteinases, thrombin, cathepsins, or beta-glucuronidase. 80. The peptide active agent conjugate or peptide of any one of embodiments 71-74, wherein the peptide is linked to the detectable agent via a stable linker. 81. The peptide active agent conjugate or peptide of any one of embodiments 71-80, wherein the detectable agent is a fluorophore, a near-infrared dye, a contrast agent, a nanoparticle, a metal-containing nanoparticle, a metal chelate, an X-ray contrast agent, a PET agent, a radioisotope, or a radionuclide chelator. 82. The peptide active agent conjugate or peptide of any one of embodiments 71-81, wherein the detectable agent is a fluorescent dye. 83. A pharmaceutical composition comprising the peptide active agent conjugate of any of the embodiments 1-3 or 5-82 or a salt thereof, or the peptide of any of embodiments 4-82 or a salt thereof, and a pharmaceutically acceptable carrier. 84. The pharmaceutical composition of embodiment 83, wherein the pharmaceutical composition is formulated for administration to a subject. 85. The pharmaceutical composition of any of embodiments 83-84, wherein the pharmaceutical composition is formulated for inhalation, intranasal administration, oral administration, topical administration, parenteral administration, intravenous administration, subcutaneous administration, intra-articular administration, intramuscular administration, intraperitoneal administration, dermal administration, transdermal administration, or a combination thereof. 86. A method of treating a condition in a subject in need thereof, the method comprising administering to the subject the peptide active agent conjugate of any of embodiments 1-3 or 5-82, the peptide of any of embodiments 4-82, or a pharmaceutical composition of any one of embodiments 83-85. 87. The method of embodiment 86, wherein the peptide active agent conjugate, peptide, or pharmaceutical composition is administered by inhalation, intranasally, orally, topically, parenterally, intravenously, subcutaneously, intra-articularly, intramuscularly administration, intraperitoneally, dermally, transdermally, or a combination thereof. 88. The method any one of embodiments 86-87, wherein the peptide active agent conjugate or the peptide homes, targets, or migrates to cartilage of the subject following administration. 89. The method of any of embodiments 86-88, wherein the condition is associated with cartilage. 90. The method of any one of embodiments 86-88, wherein the condition is associated with a joint. 91. The method of any of embodiments 86-88, wherein the condition is an inflammation, a cancer, a degradation, a growth disturbance, genetic, a tear, an infection, a disease, or an injury. 92. The method of any of embodiments 86-88, wherein the condition is a chondrodystrophy. 93. The method of any of embodiments 86-88, wherein the condition is a traumatic rupture or detachment. 94. The method of any of embodiments 86-88, wherein the condition is a costochondritis. 95. The method of any of embodiments 86-88, wherein the condition is a hemiation. 96. The method of any of embodiments 86-88, wherein the condition is a polychondritis. 97. The method of any of embodiments 86-88, wherein the condition is a chordoma. 98. The method of any of embodiments 86-88, wherein the condition is a type of arthritis. 99. The method of embodiment 98, wherein the type of arthritis is rheumatoid arthritis. 100. The method of embodiment 198, wherein the type of arthritis is osteoarthritis. 101. The method of any of embodiments 86-88, wherein the condition is achondroplasia. 102. The method of any of embodiments 86-88, wherein the condition is benign chondroma or malignant chondrosarcoma. 103. The method of any of embodiments 86-88, wherein the condition is bursitis, tendinitis, gout, pseudogout, an arthropathy, psoriatic arthritis, ankylosing spondylitis, or an infection. 104. The method of embodiment 91, wherein the peptide active agent conjugate, peptide, or pharmaceutical composition is administered to treat the injury, to repair a tissue damaged by the injury, or to treat a pain caused by the injury. 105. The method of embodiment 91, wherein the peptide active agent conjugate, peptide, or pharmaceutical composition is administered to treat the tear or to repair a tissue damaged by the tear. 106. The method of any one of embodiments 86-87, wherein the peptide active agent conjugate, peptide, or pharmaceutical composition homes, targets, or migrates to a kidney of the subject following administration. 107. The method of any one of embodiments 86-87 or 106, wherein the condition is associated with a kidney. 108. The method of embodiment 107, wherein the condition is lupus nephritis, acute kidney injury (AKI), chronic kidney disease (CKD), hypertensive kidney damage, diabetic nephropathy, or renal fibrosis. 109. A method of imaging an organ or body region of a subject, the method comprising: administering to the subject the peptide active agent conjugate of any of embodiments 1-3 or 5-82, peptide of any of embodiments 4-82, or pharmaceutical composition of any one of embodiments 83-85; and imaging the subject. 110. The method of embodiment 109, wherein further comprising detecting a cancer or diseased region, tissue, structure or cell. 111. The method of any one of embodiments 109-110, further comprising performing surgery on the subject. 112. The method of any one of embodiments 109-111, further comprising treating the cancer. 113. The method of any one of embodiments 109-111, wherein the surgery comprises removing the cancer or the diseased region, tissue, structure or cell of the subject. 114. The method of embodiment 111, further comprising imaging the cancer or diseased region, tissue, structure, or cell of the subject after surgical removal. 115. The peptide active agent conjugate of any one of embodiments 1-3 or 5-82, wherein the peptide active agent conjugate is expressed as a fusion protein. 116. A compound having the structure of Formula (I), or a pharmaceutically acceptable salt thereof:

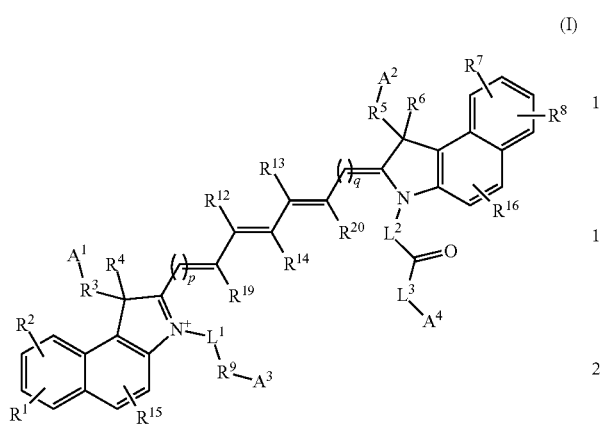

(I)

wherein: $R^1$, $R^2$, $R^3$, $R^4$, $R^5$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —$SO_2$—$NH_2$, $C_1$-$C_6$ alkoxy, $C_1$-$C_{10}$ alkylene-(C(=O))$_x$—, $C_1$-$C_{10}$ alkylene-(C(=O))$_x$—O—, or $C_1$-$C_{10}$ alkylene-(C(=O))$_x$—$NR^{10}$—; $R^9$ is hydrogen, sulfonate, —COOH, $C_1$-$C_{10}$ alkylene-(C(=O))$_x$—, $C_1$-$C_{10}$ alkylene-(C(=O))$_x$—O—, or $C_1$-$C_{10}$ alkylene-(C(=O))$_x$—$NR^{10}$—; $L^1$ is $C_3$-$C_6$ alkylene; $L^2$ is $C_1$-$C_{10}$ alkylene; $L^3$ is a bond, —O—, —$NR^{10}$—, —$NR^{10}$—$C_1$-$C_6$ alkylene-, —O—$NR^{10}$—, —$NR^{10}$—$C_1$-$C_6$ alkylene-(O—$C_1$-$C_6$ alkylene)$_n$-, —$NR^{10}$-$L^4$-, —$NR^{10}$—$C_1$-$C_6$ alkylene-$NR^{11}$—(C(=O)—$C_1$-$C_6$ alkylene-O—)$_m$—, or —$NR^{10}$—$C_1$-$C_6$ alkylene-$NR^{10}$—$C_1$-$C_6$ alkylene-$NR^{10}$—$C_1$-$C_6$ alkylene-; $L^4$ is a bond, -heterocyclyl-, or -heterocyclyl-$C_1$-$C_6$ alkylene-; $R^{10}$ is hydrogen or $C_1$-$C_6$ alkyl; $R^{11}$ is hydrogen or $C_1$-$C_6$ alkyl; $R^{12}$ and $R^{13}$ are each independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring; $R^{14}$ is hydrogen or $C_1$-$C_6$ alkylene, -($L^5$)-aryl, -($L^5$)-aryl-$A^5$, -($L^5$)-heteroaryl, -($L^5$)-heteroaryl-$A^5$, —$NR^{17}R^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring; $L^5$ is a bond, $C_1$-$C_{10}$ alkylene, —O—, or —$NR^{10}$—; $R^{17}$ and $R^{18}$ are each independently hydrogen or aryl; $R^{19}$ and $R^{20}$ are each selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring; n is 0, 1, 2, or 3; m is 0, 1, 2, or 3; p is 0, 1, 2, or 3; q is 0, 1, 2, or 3; x is 0 or 1; and one of $A^1$, $A^2$, $A^3$, $A^4$, or $A^5$ is a polypeptide having at least 85% sequence identity with MCMPCFTTDHQMARRCDDCCGGR-GRGKCYGPQCLCR or a fragment thereof and the others of $A^1$, $A^2$, $A^3$, $A^4$, or $A^5$ are each independently absent, hydrogen, —COOH, or sulfonate. 117. The compound of embodiment 116 having the structure of Formula (II), or a pharmaceutically acceptable salt thereof:

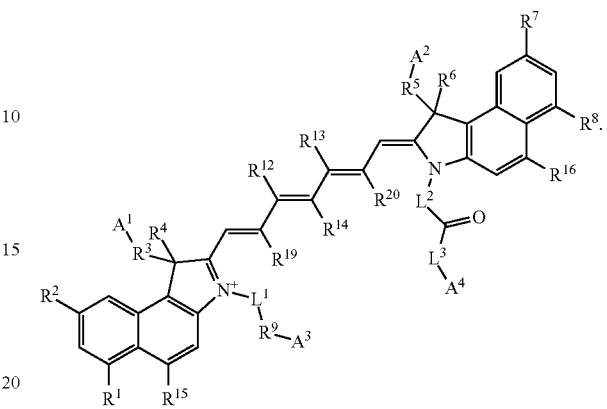

(II)

118. The compound of any one of embodiments 116 or 117 having the structure of Formula (III), or a pharmaceutically acceptable salt thereof:

(III)

wherein: $R^1$, $R^2$, $R^3$, $R^4$, $R^5$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —$SO_2$—$NH_2$, or $C_1$-$C_6$ alkoxy; $R^9$ is hydrogen, sulfonate, or —COOH; $L^1$ is $C_3$-$C_6$ alkylene; $L^2$ is $C_1$-$C_{10}$ alkylene; $L^3$ is a bond, —O—, —$NR^{10}$—, —$NR^{10}$—$C_1$-$C_6$ alkylene-, —O—$NR^{10}$—, —$NR^{10}$—$C_1$-$C_6$ alkylene-(O—$C_1$-$C_6$ alkylene)$_1$-, —$NR^{10}$-$L^4$-, —$NR^{10}$—$C_1$-$C_6$ alkylene-$NR^{11}$—(C(=O)—$C_1$-$C_6$ alkylene-O—)$_m$—, or —$NR^{10}$—$C_1$-$C_6$ alkylene-$NR^{10}$—$C_1$-$C_6$ alkylene-$NR^{10}$—$C_1$-$C_6$ alkylene-; $L^4$ is a bond, -heterocyclyl-, or -heterocyclyl-$C_1$-$C_6$ alkylene-; $R^{10}$ is hydrogen or $C_1$-$C_6$ alkyl; $R^{11}$ is hydrogen or $C_1$-$C_6$ alkyl; $R^{12}$ and $R^{13}$ are independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring; $R^{14}$ is hydrogen or $C_1$-$C_6$ alkylene, -($L^5$)-aryl, -($L^5$)-heteroaryl, —$NR^{17}R^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring; $L^5$ is a bond, $C_1$-$C_{10}$ alkylene, —O—, —$NR^{10}$—; $R^{17}$ and $R^{18}$ are each independently hydrogen or aryl; $R^{19}$ and $R^{20}$ are independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring; n is 0, 1, 2, or 3; m is 0, 1, 2, or 3; p is 0, 1, 2, or 3; q is 0, 1, 2, or 3; and $A^4$ is a polypeptide having at least 85% sequence identity with MCMPCFTTDHQMARRCDDCCGGR-GRGKCYGPQCLCR or a fragment thereof. 119. The compound of any one of embodiments 116 or 117 having the structure of Formula (IV), or a pharmaceutically acceptable salt thereof:

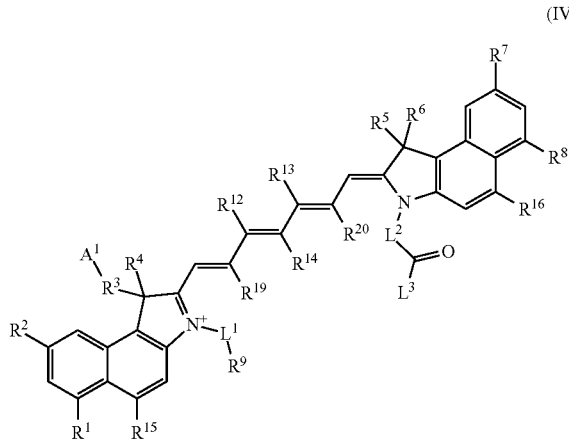

(IV)

wherein: $R^1$, $R^2$, $R^4$, $R^5$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —$SO_2$—$NH_2$, or $C_1$-$C_6$ alkoxy; $R^3$ is selected from $C_1$-$C_{10}$ alkylene-(C(=O))$_x$—, $C_1$-$C_{10}$ alkylene-(C(=O))$_x$—O—, or $C_1$-$C_{10}$ alkylene-(C(=O))$_x$—$NR^{10}$—; $R^9$ is hydrogen, sulfonate, or —COOH, or $C_1$-$C_{10}$ alkyl; $L^1$ is $C_3$-$C_6$ alkylene; $L^2$ is $C_1$-$C_{10}$ alkylene; $L^3$ is hydrogen, sulfonate, —COOH, $C_1$-$C_{10}$ alkyl; $L^4$ is a bond, -heterocyclyl-, or -heterocyclyl-$C_1$-$C_6$ alkylene-; $R^{10}$ is hydrogen or $C_1$-$C_6$ alkyl; $R^{11}$ is hydrogen or $C_1$-$C_6$ alkyl; $R^{12}$ and $R^{13}$ are independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring; $R^{14}$ is hydrogen or $C_1$-$C_6$ alkylene, -($L^5$)-aryl, -($L^5$)-heteroaryl, —$NR^{17}R^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring; $L^5$ is a bond, $C_1$-$C_{10}$ alkylene, —O—, —$NR^{10}$—; $R^{17}$ and $R^{18}$ are each independently hydrogen or aryl; $R^{19}$ and $R^{20}$ are independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring; n is 0, 1, 2, or 3; m is 0, 1, 2, or 3; p is 0, 1, 2, or 3; q is 0, 1, 2, or 3; x is 0 or 1; and $A^1$ is a polypeptide having at least 85% sequence identity with MCMPCFTTDHQMARRCDDCCGGR-GRGKCYGPQCLCR or a fragment thereof. 120. The compound of any one of embodiments 116 or 117 having the structure of Formula (V), or a pharmaceutically acceptable salt thereof:

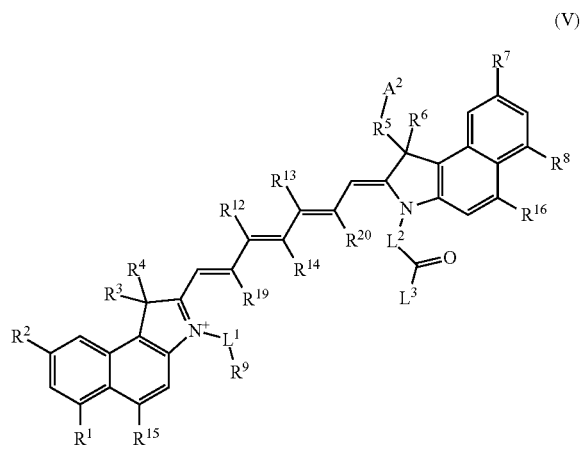

(V)

wherein: $R^1$, $R^2$, $R^3$, $R^4$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —$SO_2$—$NH_2$, or $C_1$-$C_6$ alkoxy; $R^5$ is selected from $C_1$-$C_{10}$ alkylene-(C(=O))$_x$—, $C_1$-$C_{10}$ alkylene-(C(=O))$_x$—O—, or $C_1$-$C_{10}$ alkylene-(C(=O))$_x$—$NR^{10}$—; $R^9$ is hydrogen, sulfonate, or —COOH, or $C_1$-$C_{10}$ alkyl; $L^1$ is $C_3$-$C_6$ alkylene; $L^2$ is $C_1$-$C_{10}$ alkylene; $L^3$ is hydrogen, sulfonate, —COOH, or $C_1$-$C_{10}$ alkyl; $L^4$ is a bond, -heterocyclyl-, or -heterocyclyl-$C_1$-$C_6$ alkylene-; $R^{10}$ is hydrogen or $C_1$-$C_6$ alkyl; $R^{11}$ is hydrogen or $C_1$-$C_6$ alkyl; $R^{12}$ and $R^{13}$ are independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring; $R^{14}$ is hydrogen or $C_1$-$C_6$ alkylene, -($L^5$)-aryl, -($L^5$)-heteroaryl, —$NR^{17}R^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring; $L^5$ is a bond, $C_1$-$C_{10}$ alkylene, —O—, —$NR^{10}$—; $R^{17}$ and $R^{18}$ are each independently hydrogen or aryl; $R^{19}$ and $R^{20}$ are independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring; n is 0, 1, 2, or 3; m is 0, 1, 2, or 3; p is 0, 1, 2, or 3; q is 0, 1, 2, or 3; x is 0 or 1; and $A^2$ is a polypeptide having at least 85% sequence identity with MCMPCFTTDHQMARRCDDCCGGR-GRGKCYGPQCLCR or a fragment thereof. 121. The compound of any one of embodiments 116 or 117 having the structure of Formula (VI), or a pharmaceutically acceptable salt thereof:

(VI)

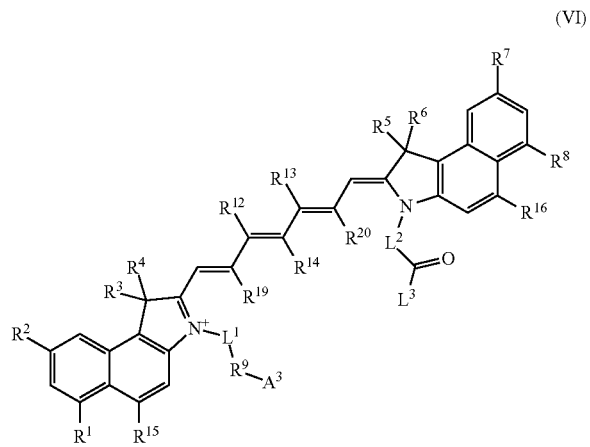

(III)

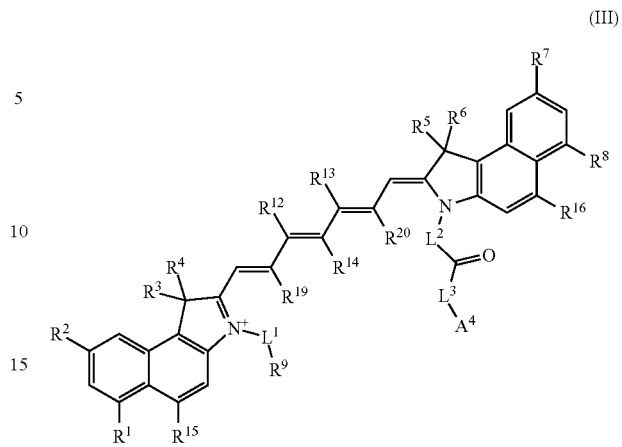

wherein: $R^1$, $R^2$, $R^3$, $R^4$, $R^5$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —SO$_2$—NH$_2$, or $C_1$-$C_6$ alkoxy; $R^9$ is selected from $C_1$-$C_{10}$ alkylene-(C(=O))$_x$—, $C_1$-$C_{10}$ alkylene-(C(=O))$_x$—O—, or $C_1$-$C_{10}$ alkylene-(C(=O))$_x$—NR$^{10}$—; $L^1$ is $C_3$-$C_6$ alkylene; $L^2$ is $C_1$-$C_{10}$ alkylene; $L^3$ is hydrogen, sulfonate, —COOH, or $C_1$-$C_{10}$ alkyl; $L^4$ is a bond, -heterocyclyl-, or -heterocyclyl-$C_1$-$C_6$ alkylene-; $R^{10}$ is hydrogen or $C_1$-$C_6$ alkyl; $R^{11}$ is hydrogen or $C_1$-$C_6$ alkyl; $R^{12}$ and $R^{13}$ are independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring; $R^{14}$ is hydrogen or $C_1$-$C_6$ alkylene, -(L$^5$)-aryl, -(L$^5$)-heteroaryl, —NR$^{17}$R$^{18}$, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring; $R^{17}$ and $R^{18}$ are each independently hydrogen or aryl; $R^{19}$ and $R^{20}$ are independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring; n is 0, 1, 2, or 3; m is 0, 1, 2, or 3; p is 0, 1, 2, or 3; q is 0, 1, 2, or 3; x is 0 or 1; $L^5$ is a bond, $C_1$-$C_{10}$ alkylene, —O—, —NR$^{10}$—; $A^3$ is a polypeptide having at least 85% sequence identity with MCMPCFTTDHQMARRCDDCCGGR-GRGKCYGPQCLCR or a fragment thereof. 122. The compound of any one of embodiments 116 or 117 having the structure of Formula (III), or a pharmaceutically acceptable salt thereof:

wherein: $R^1$, $R^2$, $R^3$, $R^4$, $R^5$, $R^6$, $R^7$, $R^8$, $R^{15}$, and $R^{16}$ are each independently selected from hydrogen, $C_1$-$C_6$ alkyl, $C_1$-$C_6$ alkylene-COOH, sulfonate, —COOH, —SO$_2$—NH$_2$, or $C_1$-$C_6$ alkoxy; $R^9$ is hydrogen, sulfonate, or —COOH; $L^1$ is $C_3$-$C_6$ alkylene; $L^2$ is $C_1$-$C_{10}$ alkylene; $L^3$ is a bond, —O—, —NR$^{10}$—, —NR$^{10}$—$C_1$-$C_6$ alkylene-, —O—NR$^{10}$—, —NR$^{10}$—$C_1$-$C_6$ alkylene-(O—$C_1$-$C_6$ alkylene)$_1$-, —NR$^{10}$-L$^4$-, —NR$^{10}$—$C_1$-$C_6$ alkylene-NR$^{11}$—(C(=O)—$C_1$-$C_6$ alkylene-O—)$_m$—, or —NR$^{10}$—$C_1$-$C_6$ alkylene-NR$^{10}$—$C_1$-$C_6$ alkylene-NR$^{10}$—$C_1$-$C_6$ alkylene-; $L^4$ is a bond, -heterocyclyl-, or -heterocyclyl-$C_1$-$C_6$ alkylene-; $R^{10}$ is hydrogen or $C_1$-$C_6$ alkyl; $R^{11}$ is hydrogen or $C_1$-$C_6$ alkyl; $R^{12}$ and $R^{13}$ are independently selected from hydrogen, $C_1$-$C_6$ alkyl, or $R^{12}$ and $R^{13}$ are joined together along with the other atoms to which they are attached to form a 5-membered or 6-membered carbocyclic or heterocyclic ring; $R^{14}$ is -(L$^5$)-aryl-A$^5$, or -(L$^5$)-heteroaryl-A$^5$; $L^5$ is a bond, $C_1$-$C_{10}$ alkylene, —O—, —NR$^{10}$—; $R^{17}$ and $R^{18}$ are each independently hydrogen or aryl; $R^{19}$ and $R^{20}$ are independently selected from hydrogen, $C_1$-$C_6$ alkyl, $R^{14}$ and $R^{19}$ are joined together along with the other atoms to which they are attached to form a 5-membered or 6-membered carbocyclic or heterocyclic ring, or $R^{14}$ and $R^{20}$ are joined together along with the other atoms to which they are attached to form a 5-membered or 6-membered carbocyclic or heterocyclic ring; n is 0, 1, 2, or 3; m is 0, 1, 2, or 3; p is 0, 1, 2, or 3; q is 0, 1, 2, or 3; x is 0 or 1; $A^4$ is hydrogen, —COOH, or sulfonate; and $A^5$ is a polypeptide having at least 85% sequence identity with MCMPCFTTDHQMARRCDDCCGGR-GRGKCYGPQCLCR or a fragment thereof. 123. The compound of any one of embodiments 116-122, wherein $A^1$, $A^2$, and $A^3$ are absent. 124. The compound of any one of embodiments 116-121, wherein $A^5$ is hydrogen. 125. The compound of any one of embodiments 116-124, wherein $R^3$, $R^4$, $R^5$, and $R^6$ are each independently $C_1$-$C_6$ alkyl. 126. The compound of any one of embodiments 116-124, wherein $R^3$, $R^4$, $R^5$, $R^6$ are each independently methyl. 127. The compound of any one of embodiments 116-126, wherein $R^1$, $R^2$, $R^7$, $R^8$, $R^{15}$, and $R^{16}$ are each independently selected from hydrogen or sulfonate. 128. The compound of any one of embodiments 116-126, wherein $R^1$, $R^2$, $R^7$, $R^8$, $R^{15}$, and $R^{16}$ are each independently hydrogen. 129. The compound of any one of embodiments 116-128, wherein $R^{12}$, $R^1$, $R^{14}$, $R^{19}$, $R^{20}$ are each independently hydrogen. 130. The compound of any one of embodiments 116-129, wherein $R^{12}$ and $R^{13}$ join together along with the atoms to which they are attached to form a six-membered carbocyclic ring. 131. The compound of any one of embodiments 116-130, wherein $R^{12}$ and $R^{13}$ join together along with the atoms to which they are attached to form a five-membered carbocyclic ring. 132. The compound of any one of embodiments 116-131, wherein $R^{14}$ and $R^{19}$ join together along with the atoms to which they are attached to form a six-membered carbocyclic ring. 133. The compound of any one of embodiments 116-132, wherein $R^{14}$ and $R^{20}$ join together along with the atoms to which they are attached to form a six-membered carbocyclic ring. 134. The compound of any one of embodiments 116-133, wherein $L^1$ is $C_3$-$C_6$ alkylene. 135. The compound of any one of embodiments 116-133, wherein $L^1$ is $C_3$-$C_5$ alkylene. 136. The compound of any one of embodiments 116-133, wherein $L^1$ is propylene. 137. The compound of any one of embodiments 116-133, wherein $L^1$ is butylene. 138. The compound of any one of embodiments 116-133, wherein $L^1$ is pentylene. 139. The compound of any one of embodiments 116-138, wherein $L^2$ is $C_3$-$C_6$ alkylene. 140. The compound of any one of embodiments 116-138, wherein $L^2$ is propylene. 141. The compound of any one of embodiments 116-138, wherein $L^2$ is butylene. 142. The compound of any one of embodiments 116-138, wherein $L^2$ is pentylene. 143. The compound of any one of embodiments 116-142, wherein $R^9$ is sulfonate. 144. The compound of any one of embodiments 116-142, wherein $R^9$ is hydrogen. 145. The compound of any one of embodiments 116-144, wherein $R^{14}$ is hydrogen. 146. The compound of any one of embodiments 116-144, wherein $R^{14}$ is -($L^5$)-aryl. 147. The compound of any one of embodiments 116-144, wherein $R^{14}$ is -($L^5$)-aryl-$A^5$. 148. The compound of any one of embodiments 116-146, wherein $R^1$ is hydrogen. 149. The compound of any one of embodiments 116-147, wherein $R^2$ is hydrogen. 150. The compound of any one of embodiments 116-148, wherein $R^3$ is methyl. 151. The compound of any one of embodiments 116-149, wherein $R^4$ is methyl. 152. The compound of any one of embodiments 116-150, wherein $R^5$ is methyl. 153. The compound of any one of embodiments 116-152, wherein $R^6$ is methyl. 154. The compound of any one of embodiments 116-153, wherein $R^7$ is hydrogen. 155. The compound of any one of embodiments 116-154, wherein $R^8$ is hydrogen. 156. The compound of any one of embodiments 116-155, wherein $R^{12}$ is hydrogen. 157. The compound of any one of embodiments 116-156, wherein $R^{13}$ is hydrogen. 158. The compound of any one of embodiments 116-157, wherein $R^{14}$ is hydrogen. 159. The compound of any one of embodiments 116-158, wherein $R^{19}$ is hydrogen. 160. The compound of any one of embodiments 116-159, wherein $R^{20}$ is hydrogen. 161. The compound of any one of embodiments 116-160, wherein $R^{17}$ and $R^{18}$ are independently phenyl. 162. The compound of any one of embodiments 116-161, wherein $L^3$ is selected from a bond, —O—, —$NR^{10}$—, —$NR^{10}$—$C_1$-$C_6$ alkylene-, —O—$NR^{10}$—, or —$NR^{10}$-$L^4$-. 163. The compound of any one of embodiments 116-162, wherein $L^3$ is a bond. 164. The compound of any one of embodiments 116-163, wherein $R^{10}$ is hydrogen. 165. The compound of any one of embodiments 116-164, wherein $L^4$ is -heterocyclyl- or -heterocyclyl-$C_1$-$C_6$ alkylene-. 166. The compound of any one of embodiments 116-165, wherein $L^4$ is -piperizinyl-($C_1$-$C_6$ alkylene)-. 167. The compound of any one of embodiments 116-166, wherein $L^4$ is

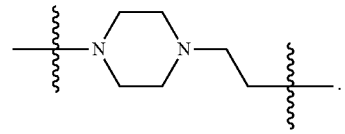 [SMILES: *CCN1CCN(*)CC1]

168. The compound of any one of embodiments 116-167, wherein $R^{11}$ is hydrogen. 169. The compound of any one of embodiments 116-168, wherein p is 1. 170. The compound of any one of embodiments 116-169, wherein q is 1. 171. The compound of any one of embodiments 116 or 117 having the structure of any one of Formulas (VII), (VIII), (IX), (X), (XI), (XII), (XIII), or (XIV):

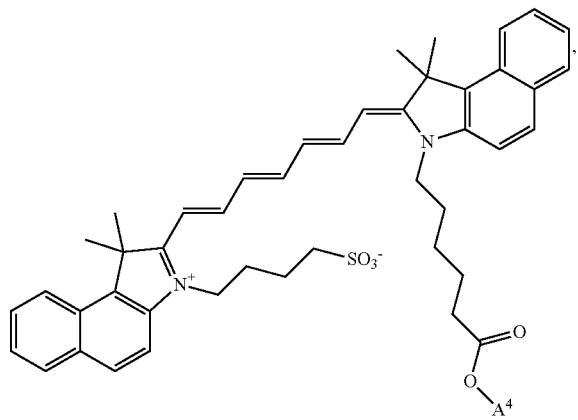

(VII)

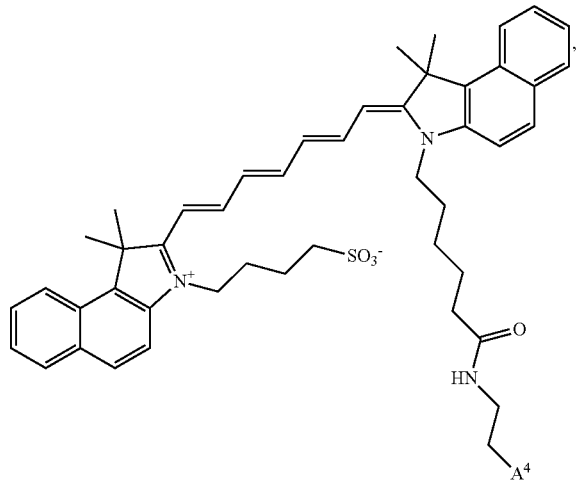

(VIII)

(IX)

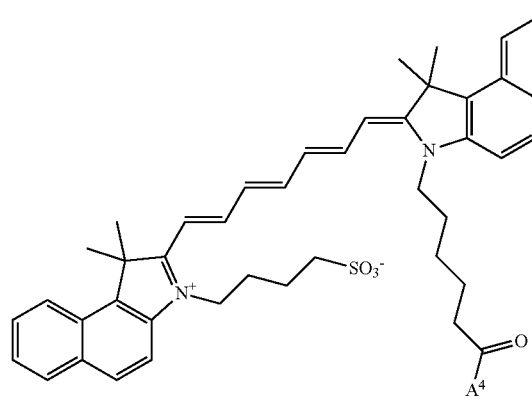

(X)

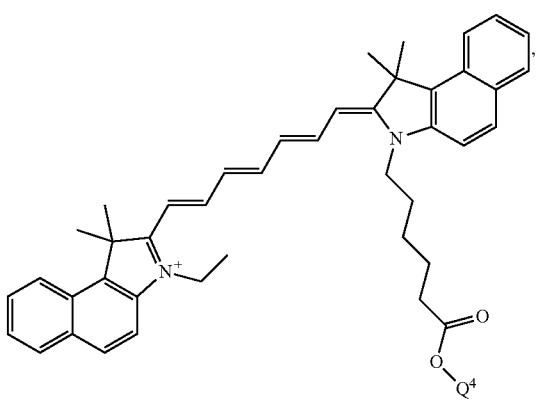

(XI)

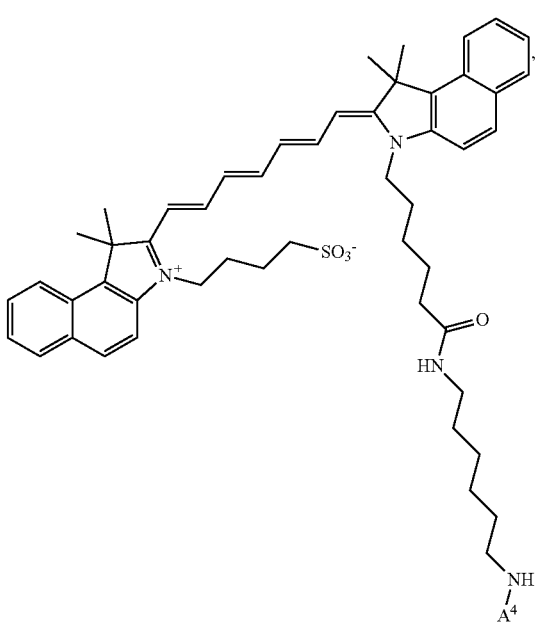

(XII)

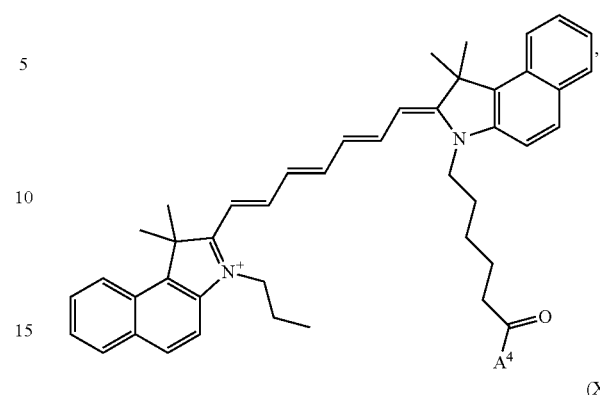

(XIII)

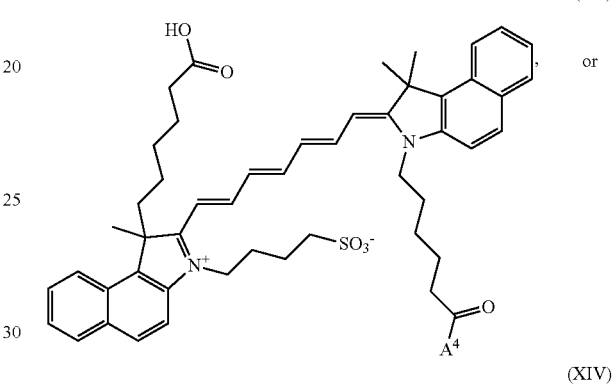

(XIV)

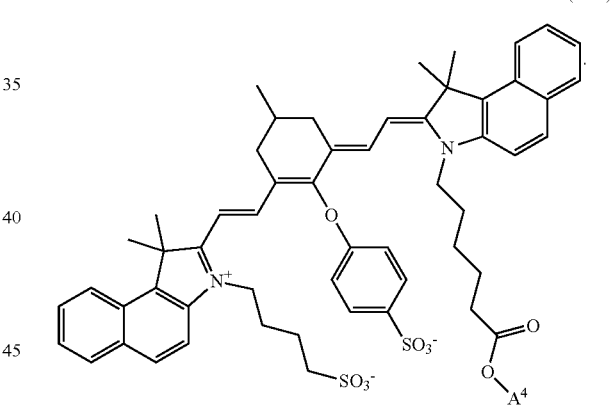

or

172. The compound of any one of embodiments 116-170, wherein one of $A^1$, $A^2$, $A^3$, $A^4$, or $A^5$ is a polypeptide having at least 87% sequence identity with MCMPCFTTDHQMARRCDDCCGGR-GRGKCYGPQCLCR or a fragment thereof. 173. The compound of any one of embodiments 116-170, wherein one of $A^1$, $A^2$, $A^3$, $A^4$, or $A^5$ is a polypeptide having at least 90% sequence identity with MCMPCFTTDHQMARRCDDCCGGR-GRGKCYGPQCLCR or a fragment thereof. 174. The compound of any one of embodiments 116-170, wherein one of $A^1$, $A^2$, $A^3$, $A^4$, or $A^5$ is a polypeptide having at least 92% sequence identity with MCMPCFTTDHQMARRCDDCCGGR-GRGKCYGPQCLCR or a fragment thereof. 175. The compound of any one of embodiments 116-170, wherein one of $A^1$, $A^2$, $A^3$, $A^4$, or $A^5$ is a polypeptide having at least 95% sequence identity with MCMPCFTTDHQMARRCDDCCGGR-GRGKCYGPQCLCR or a fragment thereof. 176. The compound of any one of embodiments 116-170, wherein one of $A^1$, $A^2$, $A^3$, $A^4$, or $A^5$ is a polypeptide having at least 97% sequence identity with MCMPCFTTDHQMARRCDDCCGGR-GRGKCYGPQCLCR or a fragment thereof. 177. The compound of any one of embodiments 116-170, wherein one of $A^1$, $A^2$, $A^3$, $A^4$, or $A^5$ is a polypeptide having 100% sequence identity with MCMPCFTTDHQMARRCDDCCGGR-GRGKCYGPQCLCR or a fragment thereof. 178. The compound of any one of embodiments 116-170, wherein one of $A^1$, $A^2$, $A^3$, $A^4$, or $A^5$ is a polypeptide having the sequence MCMPCFTTDHQMARRCDDCCGGR-GRGKCYGPQCLCR or a fragment thereof. 179. The compound of any one of embodiments 116-178, wherein the fragment of $A^1$, $A^2$, $A^3$, $A^4$, or $A^5$ has a length of at least 25 amino acid residues. 180. The compound of any one of embodiments 116-178, wherein the fragment of $A^1$, $A^2$, $A^3$, $A^4$, or $A^5$ has a length of at least 27 amino acid residues. 181. The compound of any one of embodiments 116-178, wherein the fragment of $A^1$, $A^2$, $A^3$, $A^4$, or $A^5$ has a length of at least 29 amino acid residues. 182. The compound of any one of embodiments 116-178, wherein the fragment of $A^1$, $A^2$, $A^3$, $A^4$, or $A^5$ has a length of at least 31 amino acid residues. 183. The compound of any one of embodiments 116-178, wherein the fragment of $A^1$, $A^2$, $A^3$, $A^4$, or $A^5$ has a length of at least 33 amino acid residues. 184. The compound of any one of embodiments 116-183, wherein one of $A^1$, $A^2$, $A^3$, $A^4$, or $A^5$ is a polypeptide having at least 85% sequence identity with MCMPCFTTDHQMARRCDDCCGGR-GRGKCYGPQCLCR or a fragment thereof having the tumor cell binding affinity of native chlorotoxin. 185. The compound of any one of embodiments 116-183, wherein one of $A^1$, $A^2$, $A^3$, $A^4$, or $A^5$ is a polypeptide having at least 85% sequence identity with MCMPCFTTDHQMARRCDDCCGGR-GRGKCYGPQCLCR or a fragment thereof having essentially the same the tumor cell binding affinity of native chlorotoxin. 186. The compound of any one of embodiments 116-185, wherein one of $A^1$, $A^2$, $A^3$, $A^4$, or $A^5$ is a polypeptide having at least 85% sequence identity with MCMPCFTTDHQMARRCDDCCGGR-GRGKCYGPQCLCR or a fragment thereof having the tumor cell binding affinity of native chlorotoxin wherein one of $A^1$, $A^2$, $A^3$, $A^4$, or $A^5$ has a sequence selected from SEQ ID NOS: 1-481. 187. The compound of any one of embodiments 116-186, wherein the polypeptide comprises at least one lysine amino acid residue. 188. The compound of any one of embodiments 116-187, wherein the polypeptide comprises a single lysine amino acid residue. 189. The compound of any one of embodiments 116-187, wherein the polypeptide comprises one, two, or three lysine amino acid residues. 190. The compound of any one of embodiments 116-189, wherein the polypeptide comprises a lysine residue at the position corresponding to K-27 of native chlorotoxin. 191. The compound of any one of embodiments 116-190, wherein the polypeptide comprises a lysine residue at the position corresponding to K-23 of native chlorotoxin. 192. The compound of any one of embodiments 116-191, wherein the polypeptide comprises a lysine residue at the position corresponding to K-15 of native chlorotoxin. 193. The compound of any one of embodiments 116-192, wherein one or more of the amino acids of the polypeptide is substituted with a non-naturally occurring amino acid residue. 194. The compound of any one of embodiments 116-193, wherein a lysine is replaced with a nonnaturally occurring amino acid. 195. The compound of embodiment 194, wherein the non-naturally occurring amino acid residue is a citrulline amino acid residue. 196. The compound of embodiment 195, wherein $L^3$ is attached to $A^4$ at a citrulline amino acid residue of the polypeptide. 197. The compound of any one of embodiments 116-196, wherein $L^3$ is attached to $A^4$ at a lysine amino acid residue of the polypeptide. 198. The compound of any one of embodiments 116-196, wherein $L^3$ is attached to $A^4$ at the N-terminus of the polypeptide. 199. The compound of any one of embodiments 116-196, wherein $L^3$ is attached to $A^4$ at the C-terminus of the polypeptide. 200. The compound of any one of embodiments 116-196, wherein the $R^3$ is attached to $A^1$ at a lysine amino acid residue of the peptide, a citrulline amino acid residue of the polypeptide, the N-terminus of the polypeptide, or the C-terminus of the polypeptide. 201. The compound of any one of embodiments 116-196, wherein the $R^5$ is attached to $A^2$ at a lysine amino acid residue of the polypeptide, a citrulline amino acid residue of the polypeptide, the N-terminus of the polypeptide, or the C-terminus of the polypeptide. 202. The compound of any one of embodiments 116-196, wherein the $R^9$ is attached to $A^3$ at a lysine amino acid residue of the polypeptide, a citrulline amino acid residue of the polypeptide, the N-terminus of the polypeptide, or the C-terminus of the polypeptide. 203. The compound of any one of embodiments 116-196, wherein the aryl is attached to $A^5$ at a lysine amino acid residue of the polypeptide, a citrulline amino acid residue of the polypeptide, the N-terminus of the polypeptide, or the C-terminus of the polypeptide. 204. The compound of any one of embodiments 116-203, having the structure of any one of compounds 1 to 720 as found in Tables 2-13. 205. The compound of any one of embodiments 116-204, wherein the compound is conjugated to polyethylene glycol (PEG), hydroxyethyl starch, polyvinyl alcohol, a water soluble polymer, a zwitterionic water soluble polymer, a water soluble poly(amino acid), an albumin derivative, or a fatty acid. 206. The compound of any one of embodiments 116-205, wherein the polypeptide has an isoelectric point of from 7.5 to 9.0. 207. The compound of any one of embodiments 116-206, wherein the polypeptide has an isoelectric point of from 8.0 to 9.0. 208. The compound of any one of embodiments 116-205, wherein the polypeptide has an isoelectric point of from 8.5 to 9.0. 209. The compound of any one of embodiments 116-208, wherein the polypeptide comprises at least eight cysteine amino acid residues. 210. The compound of any one of embodiments 116-208, wherein the polypeptide comprises eight cysteine amino acid residues. 211. The compound of any one of embodiments 116-210, wherein the polypeptide comprises four disulfide bonds. 212. The compound of any one of embodiments 116-208, wherein the polypeptide comprises from six to seven cysteine amino acid residues. 213. The compound of any one of embodiments 116-208, wherein the polypeptide comprises three disulfide bonds. 214. The compound of any one of embodiments 116-213, wherein the polypeptide is basic and has an isoelectric point of greater than 7.5. 215. The compound of any one of embodiments 116-214, wherein the spacing between the cysteine amino acid residues in the polypeptide is essentially the same as in native chlorotoxin. 216. The compound of any one of embodiments 116-215, wherein the distribution of charge on the surface of the polypeptide is essentially the same as in native chlorotoxin. 217. The compound of any one of embodiments 116-216, wherein one or more of the methionine amino acid residues is replaced with an amino acid residue selected from isoleucine, threonine, valine, leucine, serine, glycine, alanine, or a combination thereof. 218. The compound of any one of embodiments 116-217, wherein the compound is capable of passing across the blood brain barrier. 219. The compound of any one of embodiments 116-218, further comprising a therapeutic agent attached to A. 220. The compound of embodiment 219, wherein the therapeutic agent is a cytotoxic agent. 221. A composition comprising the compound of any one of embodiments 116-220 and a pharmaceutically acceptable carrier. 222. The composition of embodiment 221, wherein the composition is formulated for parenteral administration. 223. The composition of any one of embodiments 221-222, wherein the composition is formulated for intravenous administration, intramuscular administration, subcutaneous administration, or a combination thereof. 224. The composition of any one of embodiments 221-223, wherein the pharmaceutically acceptable carrier comprises an osmolyte. 225. The composition of embodiments 224, wherein the osmolyte comprises a sugar, a sugar alcohol, or a combination thereof. 226. The composition of embodiment 225, wherein the sugar alcohol is selected from sorbitol, inositol, mannitol, xylitol and glycerol, or a combination thereof. 227. The composition of any one of embodiments 225-226, wherein the sugar alcohol comprises mannitol. 228. The composition of any one of embodiments 226-227, comprising from 2% to 20% (wt/vol %) mannitol. 229. The composition of any one of embodiments 226-227, comprising from 2% to 10% (wt/vol %) mannitol. 230. The composition of any one of embodiments 226-227, comprising essentially 5% (wt/vol %) mannitol. 231. The composition of embodiment 225, wherein the sugar is selected from trehalose, lactose, sucrose, glucose, galactose, maltose, mannose, fructose, dextrose, or a combination thereof. 232. The composition of embodiment 225, wherein the sugar is selected from trehalose, sucrose, or a combination thereof. 233. The composition of any one of embodiments 231-232, comprising from 1% to 40% (wt/vol %) of trehalose, sucrose, or a combination of trehalose and sucrose. 234. The composition of any one of embodiments 231-232, comprising from 1% to 20% (wt/vol %) of trehalose, sucrose, or a combination of trehalose and sucrose. 235. The composition of any one of embodiments 231-232, comprising 2% (wt/vol %) of trehalose, sucrose, or a combination of trehalose and sucrose. 236. The composition of embodiment 211, wherein the osmolyte is selected from glycine, carnitine, ethanolamine, their phosphates, mono sugars, or a combination thereof. 237. The composition of any one of embodiments 221-236, wherein the composition is isotonic. 238. The composition of any one of embodiments 221-236, wherein the composition is essentially isotonic. 239. The composition of any one of embodiments 221-238, wherein the ionic strength of the composition is less than 50 mM. 240. The composition of any one of embodiments 221-238, wherein the ionic strength of the composition is less than 10 mM. 241. The composition of any one of embodiments 221-240, wherein the pharmaceutically acceptable carrier comprises a buffer. 242. The composition of embodiment 241, wherein the buffer is selected from tris, HEPES, histidine, ethylene diamine, or a combination thereof. 243. The composition of embodiment 241, wherein the buffer is selected from tris, histidine, or a combination thereof. 244. The composition of embodiment 241, wherein the buffer comprises histidine. 245. The composition of embodiment 244, wherein histidine is L-histidine. 246. The composition of any one of embodiments 244-245, comprising at least 100 mM histidine. 247. The composition of any one of embodiments 244-245, comprising at least 50 mM histidine. 248. The composition of any one of embodiments 244-245, comprising at least 20 mM histidine. 249. The composition of any one of embodiments 244-245, comprising 10 to 100 mM histidine. 250. The composition of any one of embodiments 244-245, comprising 10 to 20 mM histidine. 251. The composition of any one of embodiments 221-250, wherein the pharmaceutically acceptable carrier comprises an antioxidant, a free radical scavenger, a quencher, an antioxidant synergist or a combination thereof. 252. The composition of embodiment 251, wherein the antioxidant is selected from methionine, butylated hydroxytoluene, butylated hydroxyanisole, propyl gallate, or a combination thereof. 253. The composition of embodiment 252, wherein the antioxidant comprises methionine. 254. The composition of embodiment 253, wherein the methionine is L-methionine. 255. The composition of any one of embodiments 252-254, comprising at least 20 mM methionine. 256. The composition of any one of embodiments 252-254, comprising at least 10 mM methionine. 257. The composition of any one of embodiments 221-256, wherein the pharmaceutically acceptable carrier comprises a surfactant. 258. The composition of embodiment 257, wherein the surfactant is selected from polysorbate 20, polysorbate 80, a pluronic, polyoxyethylene sorbitan mono-oleate, polyethylene mono-laureate, N-actyl-glucoside, or a combination thereof. 259. The composition of embodiment 257, wherein the surfactant is polysorbate 20. 260. The composition of any one of embodiments 258-259, comprising from 0.00010% to 0.10% (wt/vol %) polysorbate 20. 261. The composition of any one of embodiments 221-260, wherein the pharmaceutically acceptable carrier comprises a cyclodextrin. 262. The composition of embodiment 261, wherein the cyclodextrin is (2-hydroxypropyl)-β-cyclodextrin. 263. The composition of any one of embodiments 221-262, wherein the pharmaceutically acceptable carrier comprises a reconstitution stabilizer. 264. The composition of embodiment 263, wherein the reconstitution stabilizer comprises a water-soluble polymer. 265. The composition of embodiment 264, wherein the water-soluble polymer is selected from a polaxamer, a polyol, a polyethylene glycol, a polyvinylalcohol, a hydroxyethyl starch, dextran, polyvinylpyrrolidene poly(acrylic acid), or a combination thereof. 266. The composition of any one of embodiments 221-265, further comprising a metal chelator. 267. The composition of embodiment 266, wherein the metal chelator is selected from EDTA, deferoxamine mesylate, EGTA, fumaric acid, and malic acid, salts thereof, or combinations thereof. 268. The composition of any one of embodiments 266-267, wherein the metal chelator comprises EDTA or salts thereof. 269. The composition of embodiment 153, having an EDTA concentration of about 0.0001 mg/ml to about 0.01 mg/ml. 270. The composition of any one of embodiments 221-269, having a pH of from 6 to 7.5. 271. The composition of any one of embodiments 221-256, having a pH of from 6.5 to 7.0. 272. The composition of any one of embodiments 221-270, wherein the concentration of the compound is from 1 mg/mL to 40 mg/mL. 273. The composition of any one of embodiments 221-270, wherein the concentration of the compound is from 1 mg/mL to 20 mg/mL. 274. The composition of any one of embodiments 221-270, wherein the concentration of the compound is from 4 mg/mL to 10 mg/mL. 275. The composition of any one of embodiments 221-270, wherein the concentration of the compound is from 5 mg/mL to 8 mg/mL. 276. The composition of any one of embodiments 221-270, wherein the concentration of the compound is from 5 mg/mL to 6 mg/mL. 277. The composition of any one of embodiments 221-276, wherein the pharmaceutically acceptable carrier comprises tris, D-mannitol, and a pH of essentially 6.8. 278. The composition of any one of embodiments 221-276, wherein the pharmaceutically acceptable carrier consists essentially of tris, D-mannitol, and a pH of 6.8. 279. The composition of any one of embodiments 221-276, wherein the pharmaceutically acceptable carrier comprises L-histidine, D-mannitol, L-methionine, and a pH of essentially 6.8. 280. The composition of any one of embodiments 221-276, wherein the pharmaceutically acceptable carrier consists essentially of L-histidine, D-mannitol, L-methionine, and a pH of 6.8. 281. The composition of any one of embodiments 221-276, wherein the pharmaceutically acceptable carrier comprises L-histidine, D-mannitol, polysorbate 20, and a pH of essentially 6.8. 282. The composition of any one of embodiments 221-276, wherein the pharmaceutically acceptable carrier comprises L-histidine, D-mannitol, and a pH of essentially 6.8. 283. The composition of any one of embodiments 221-276, wherein the pharmaceutically acceptable carrier comprises L-histidine, D-mannitol, polysorbate 20, trehalose, and a pH of essentially 6.8. 284. The composition any one of embodiments 221-283, wherein the composition is lyophilized. 285. A method of producing the composition of embodiment 284, the method comprising: providing the composition; and lyophilizing the composition, thereby producing the lyophilized composition. 286. The composition of any one of embodiments 221-285, wherein the composition is reconstituted from a lyophilized form. 287. A method of producing the composition of embodiment 286, the method comprising: providing the lyophilized composition of embodiment 284; and reconstituting the composition with a solution to produce a reconstituted composition. 288. The composition of embodiment 286, wherein the solution comprises water. 289. A composition comprising a polypeptide conjugated to a fluorescent dye and histidine. 290. The composition of embodiment 289, wherein the histidine is L-histidine. 291. The composition of any one of embodiments 289-290, comprising at least 50 mM histidine. 292. The composition of any one of embodiments 289-290, comprising at least 20 mM histidine. 293. The composition of any one of embodiments 289-290, comprising 10 to 100 mM histidine. 294. The composition of any one of embodiments 289-290, comprising 10 to 20 mM histidine. 295. The composition of any one of embodiments 289-294, wherein the polypeptide conjugated to the fluorescent dye is a compound of any one of embodiments 116-220. 296. A kit comprising: a vessel configured to contain a fluid; the composition of any one of embodiments 221-295 comprised within the vessel; and an elastomeric closure affixed to the vessel. 297. The kit of embodiment 296, further comprising a light shield. 298. The kit of embodiment 297, wherein the light shield is a physical barrier configured to block at least a portion of the light incident on the vessel from the composition. 299. The kit of embodiment 298, wherein the physical barrier comprises an opaque or semi-opaque material. 300. The kit of any one of embodiments 296-299, wherein the vessel is a glass vial. 301. The kit of embodiment 300, wherein the glass vial comprises clear or amber glass. 302. The kit of any one of embodiments 296-301, wherein the glass vial is an untreated glass container. 303. The kit of any one of embodiments 300-302, wherein the glass vial comprises USP Type I, Type II, Type III, or Type IV glass. 304. The kit of any one of embodiments 296-303, wherein the inner portion of the vessel further comprises a silica ($SiO_2$) coating or silicone coating. 305. The kit of any one of embodiments 302-304, wherein the untreated glass container is selected from an ampoule, vial, ready-to-use syringe, or carpule. 306. The kit of any one of embodiments 296-305, wherein the elastomeric closure is a halobutyl rubber closure. 307. The kit of embodiment 306, wherein the halobutyl rubber closure is selected from a chlorobutyl rubber closure or a bromobutyl rubber closure. 308. The kit of any one of embodiments 296-307, wherein the elastomeric closure is coated with Fluorotec, B2, or a combination thereof. 309. The kit of any one of embodiments 296-308, further comprising an opaque secondary package surrounding the vessel. 310. The kit of embodiment 309, wherein the opaque secondary package comprises an opaque box, an opaque aluminum foil pouch, or a combination thereof. 311. The kit of any one of embodiments 309-310, wherein the opaque secondary package is configured to block at least 90% of the light incident on the package exterior from the composition. 312. The kit of any one of embodiments 309-310, wherein the opaque secondary package is configured to block at least 95% of the light incident on the package exterior from the composition. 313. The kit of any one of embodiments 309-310, wherein the opaque secondary package is configured to block at least 99% of the light incident on the package exterior from the composition. 314. The kit of any one of embodiments 309-310, wherein the opaque secondary package is configured to block at least 99.9% of the light incident on the package exterior from the composition. 315. The kit of any one of embodiments 296-314, wherein the vessel comprises a reduced-oxygen environment in contact with the composition. 316. The kit of any one of embodiments 296-315, wherein the vessel comprises an inert gas in contact with the composition. 317. The kit of any one of embodiments 315-316, wherein the composition is sparged with an inert gas, thereby producing the reduced-oxygen environment in the vessel. 318. The kit of any one of embodiments 201 to 202, wherein the inert gas comprises nitrogen or argon. 319. A composition comprising a compound comprising a polypeptide having at least 85% sequence identity with MCMPCFTTDHQMARRCDDCCGGR-GRGKCYGPQCLCR or a fragment thereof, wherein when the composition is intravenously administering to a human subject at a dose of from 1 mg to 30 mg, the composition produces in the human subject an average maximum compound blood plasma concentration (average $C_{max}$) of at least from 110 ng/mL to 240 ng/mL per each 1 mg dosage of the compound administered. 320. The composition of embodiment 303, wherein the compound comprises the compound of any one of embodiments 116-120. 321. The composition of any one of embodiments 319-320, wherein the composition comprises the composition of any one of embodiments 221-295. 322. A method of administering a composition to a human subject, the method comprising: intravenously administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof; and producing in the human subject an average maximum compound blood plasma concentration (average $C_{max}$) of at least from 110 ng/mL to 240 ng/mL per each 1 mg dosage of the compound administered. 323. A method of detecting a cancer cell in a human subject, the method comprising: intravenously administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof conjugated to a detectable label; producing in the human subject an average maximum compound blood plasma concentration (average $C_{max}$) of at least from 110 ng/mL to 240 ng/mL per each 1 mg dosage of the compound administered; and detecting the presence or absence of the detectable label in the human subject, wherein the presence of the detectable label indicates the presence of the cancer cell. 324. A method of diagnosing cancer in a human subject, the method comprising: intravenously administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof conjugated to a detectable label; producing in the human subject an average maximum compound blood plasma concentration (average $C_{max}$) of at least from 110 ng/mL to 240 ng/mL per each 1 mg dosage of the compound administered; and detecting the presence or absence of the detectable label in the human subject, wherein the presence of the detectable label indicates a diagnosis of cancer. 325. A method of treating cancer in a human subject, the method comprising: intravenously administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof conjugated to a therapeutic agent; producing in the human subject an average maximum compound blood plasma concentration (average $C_{max}$) of at least from 110 ng/mL to 240 ng/mL per each 1 mg dosage of the compound administered; and reducing or improving a symptom or condition associated with cancer in the human subject. 326. The method of embodiment 325, wherein the human subject is in need thereof. 327. The method of any one of embodiments 325-326, comprising administering a therapeutically effective dose of the compound to the human subject. 328. A method of administering a composition to a human subject, the method comprising: intravenously administering to the human subject a dose of from 1 mg to 30 mg of a compound comprising a polypeptide having at least 85% sequence identity with MCMPCFTTDHQMARRCDDCCGGR-GRGKCYGPQCLCR or a fragment thereof; and producing in the human subject pharmacokinetic profile of FIG. 27. 329. A method of administering a composition to a human subject, the method comprising: intravenously administering to the human subject a dose of from 1 mg to 30 mg of a compound of any one of embodiments 116-220; and producing in the human subject an average maximum compound blood plasma concentration (average $C_{max}$) of at least from 110 ng/mL to 240 ng/mL per each 1 mg dosage of the compound administered. 330. The method of any one of embodiments 322-329, wherein the average time (average $T_{max}$) at which the average $C_{max}$ is reached is at 5±4 minutes following administration of the compound. 331. The method of any one of embodiments 322-330, wherein the average time (average $T_{75}$) at which the average compound blood plasma concentration reaches 75% of the average $C_{max}$ (average $C_{75}$) is reached is at 8±5 minutes following administration of the compound. 332. The method of any one of embodiments 322-331, wherein the average time (average $T_{50}$) at which the average compound blood plasma concentration reaches 50% of the average $C_{max}$ (average $C_{50}$) is reached is at 20±8 minutes following administration of the compound. 333. The method of any one of embodiments 322-332, wherein the average time (average $T_{25}$) at which the average compound blood plasma concentration reaches 25% of the average $C_{max}$ (average $C_{25}$) is reached is at 30±12 minutes following administration of the compound. 334. The method of any one of embodiments 322-333, further comprising producing in the human subject an average chlorotoxin polypeptide plasma area under the curve (average AUC) of from 50 hr*ng/mL to 120 hr*ng/mL per each 1 mg dosage of chlorotoxin polypeptide administered. 335. The method of any one of embodiments 334-334, further comprising producing in the human subject an average chlorotoxin polypeptide plasma area under the curve (average AUC) of from 60 hr*ng/mL to 110 hr*ng/mL per each 1 mg dosage of chlorotoxin polypeptide administered. 336. The method of embodiment 335, wherein 75% of the average AUC occurs within 40±15 minutes after administering the compound. 337. The method of any one of embodiments 335-336, wherein 50% of the average AUC occurs within 21±8 minutes after administering the compound. 338. The method of any one of embodiments 335-337, wherein 25% of the average AUC occurs within 9±5 minutes after administering the compound. 339. The method of any one of embodiments 322-338, wherein the compound comprises the compound of any one of embodiments 116-220. 340. The method of any one of embodiments 207 to 223, wherein the composition comprises the composition of any one of embodiments 221-295. 341. A method for detecting a cancer cell in a subject, the method comprising: administering to the subject the compound of any one of embodiments 116-220; and detecting the presence or absence of the compound in the subject, wherein the presence of the compound indicates the presence of a cancer cell. 342. The method of embodiment 341, further comprising administering the compound as a part of a composition of any one of embodiments 221-295. 343. The method of any one of embodiments 322 and 342, wherein the cancer is selected from glioma, astrocytoma, medulloblastoma, choroids plexus carcinoma, ependymoma, brain tumor, neuroblastoma, adenocarcinoma, basal cell carcinoma, squamous cell carcinoma, head and neck cancer, lung cancer, breast cancer, intestinal cancer, pancreatic cancer, liver cancer, kidney cancer, sarcoma, osteosarcoma, rhabdomyosarcoma, Ewing's sarcoma, carcinoma, melanoma, ovarian cancer, cervical cancer, lymphoma, thyroid cancer, anal cancer, colo-rectal cancer, endometrial cancer, germ cell tumor, laryngeal cancer, multiple myeloma, prostate cancer, retinoblastoma, gastric cancer, testicular cancer, or Wilm's tumor. 344. The method of any one of embodiments 332 and 342, wherein the cancer is selected from glioma, medulloblastoma, sarcoma, breast cancer, lung cancer, prostate cancer, or intestinal cancer. 345. The method of any one of embodiments 322-344, wherein the cancer cell expresses a site to which native chlorotoxin binds. 346. The method of any one of embodiments 322-345, comprising detecting the compound by fluorescence imaging. 347. The method of any one of embodiments 322-345, further comprising differentiating a focus of a cancer that expresses a site to which native chlorotoxin binds from non-neoplastic tissue. 348. The method of any one of embodiments 322-347, further comprising surgically removing from the subject a cancer cell that is detected. 349. The method of any one of embodiments 322-348, further comprising determining the location of a cancer cell in the subject before surgically removing the cancer cell from the subject, during surgical removal of the cancer cell from the subject, after removing the cancer cell from the subject, or a combination thereof. 350. The method of any one of embodiments 322-349, wherein the compound binds to the cancer cell. 351. The method of any one of embodiments 322-350, wherein the subject is a human subject. 352. The method of any one of embodiments 323-351, wherein the detection is performed in vivo or ex vivo. 353. A method of administering the compound of any one of embodiments 116-220 to a subject, the method comprising administering a therapeutically effective amount of the compound to the subject. 354. The method of any one of embodiments 322-353, wherein the subject is in need thereof. 355. The method of any one of embodiments 353-354, wherein a therapeutically effective amount is a dosage sufficient for the detection of a cancer cell in the subject. 356. The method of any one of embodiments 322-355, wherein the dosage is from 0.1 mg to 100 mg. 357. The method of any one of embodiments 322-355, wherein the dosage is from 1 mg to 30 mg. 358. The method of any one of embodiments 322-355, wherein the dosage is from 3 mg to 30 mg. 359. A method of treating a subject in need thereof, the method comprising administering to the subject the composition of any one of embodiments 219-220 in an amount sufficient to treat cancer in the subject. 360. The method of embodiment 359, wherein the cancer is selected from glioma, astrocytoma, medulloblastoma, choroids plexus carcinoma, ependymoma, brain tumor, neuroblastoma, head and neck cancer, lung cancer, breast cancer, intestinal cancer, pancreatic cancer, liver cancer, kidney cancer, sarcoma, osteosarcoma, rhabdomyosarcoma, Ewing's sarcoma, carcinoma, melanoma, ovarian cancer, cervical cancer, lymphoma, thyroid cancer, anal cancer, colo-rectal cancer, endometrial cancer, germ cell tumor, laryngeal cancer, multiple myeloma, prostate cancer, retinoblastoma, gastric cancer, testicular cancer, or Wilm's tumor. 361. The method of embodiment 359, wherein the cancer cell is selected from glioma, medulloblastoma, sarcoma, prostate cancer, or intestinal cancer. 362. The method of any one of embodiments 322-361, wherein the cancer cell expresses a site to which native chlorotoxin binds. 363. The method of embodiment 362, wherein the binding is selective. 364. The method of any one of embodiments 322-363, wherein the compound is administered parenterally. 365. The method of any one of embodiments 341-364, wherein the compound is administered intravenously. 366. The method of any one of embodiments 341-364, wherein the compound is administered subcutaneously. 367. A method of detecting soft-tissue sarcoma in an individual, comprising the steps of: a) administering a chlorotoxin conjugate to the individual, wherein the chlorotoxin conjugate binds to the soft-tissue sarcoma; and b) imaging, visualizing, or analyzing the bound chlorotoxin conjugate. 368. The method of embodiment 367, wherein the detecting comprises in vivo, or ex vivo detection. 369. The method of embodiment 367, wherein the imaging, visualizing, or analyzing comprises visualizing the chlorotoxin conjugate optically. 370. The method of embodiment 367, wherein the imaging, visualizing, or analyzing comprises in vivo, or ex vivo imaging, visualizing, or analyzing. 371. The method of embodiment 370, wherein the imaging, visualizing, or analyzing comprises optically imaging the sarcoma. 372. The method of embodiment 367, wherein the chlorotoxin conjugate comprises one or more labeling agents. 373. The method of embodiment 372, wherein the labeling agent comprises a fluorescent moiety. 374. The method of embodiment 373, wherein the fluorescent moiety comprises a near infrared fluorescent moiety. 375. The method of embodiment 372, wherein the labeling agent comprises a radionuclide. 376. The method of embodiment 367, wherein the soft-tissue sarcoma is in subcutaneous fatty tissue. 377. The method of embodiment 367, wherein the detecting is performed during or related to surgery or resection. 378. A method of detecting and removing soft-tissue sarcoma in an individual comprising the steps of: c) administering a chlorotoxin conjugate to the individual, wherein the chlorotoxin conjugate binds to the squamous cell carcinoma or cutaneous cell carcinoma; and d) imaging, visualizing, or analyzing the bound chlorotoxin conjugate, and removing the tissue bound by the chlorotoxin conjugate. 379. A method of detecting cutaneous squamous cell carcinoma in an individual, comprising the steps of: e) administering a chlorotoxin conjugate to the individual, wherein the chlorotoxin conjugate binds to the cutaneous squamous cell carcinoma; and f) imaging, visualizing, or analyzing the bound chlorotoxin conjugate. 380. The method of embodiment 379, wherein the detecting comprises in vivo, or ex vivo detection. 381. The method of embodiment 379, wherein the imaging, visualizing, or analyzing comprises visualizing the chlorotoxin conjugate optically. 382. The method of embodiment 381, wherein the imaging, visualizing, or analyzing comprises in vivo, or ex vivo imaging, visualizing, or analyzing. 383. The method of embodiment 382, wherein the imaging, visualizing, or analysis comprises optically imaging the cutaneous squamous cell carcinoma. 384. The method of embodiment 379, wherein the chlorotoxin conjugate comprises one or more labeling agents. 385. The method of embodiment 384, wherein the labeling agent comprises a fluorescent moiety. 386. The method of embodiment 385, wherein the fluorescent moiety comprises a near infrared fluorescent moiety. 387. The method of embodiment 384, wherein the labeling agent comprises a radionuclide. 388. A method of detecting and removing cutaneous squamous cell carcinoma in an individual comprising the steps of: g) administering a chlorotoxin conjugate to the individual, wherein the chlorotoxin conjugate binds to the cutaneous squamous cell carcinoma; and h) imaging, visualizing, or analyzing the bound chlorotoxin conjugate, and removing the tissue bound by the chlorotoxin conjugate. 389. The method of embodiment 388, wherein the cutaneous squamous cell carcinoma, or a portion thereof, is removed during or related to surgery. 390. A method of detecting a low-grade tumor in an individual, comprising the steps of: i) administering a chlorotoxin conjugate to the individual, wherein the chlorotoxin conjugate binds to the low-grade tumor; and j) imaging, visualizing, or analyzing the bound chlorotoxin conjugate. 391. The method of embodiment 390, wherein the detecting comprises in vivo, or ex vivo detection. 392. The method of embodiment 390, wherein the imaging, visualizing, or analyzing comprises visualizing the chlorotoxin conjugate optically. 393. The method of embodiment 392, wherein the imaging, visualizing, or analyzing comprises in vivo, or ex vivo imaging, visualizing, or analyzing. 394. The method of embodiment 393, wherein the imaging, visualizing, or analyzing comprises optically imaging the low-grade tumor. 395. The method of embodiment 390, wherein the chlorotoxin conjugate comprises one or more labeling agents. 396. The method of embodiment 395, wherein the labeling agent comprises a fluorescent moiety. 397. The method of embodiment 396, wherein the fluorescent moiety comprises a near infrared fluorescent moiety. 398. The method of embodiment 395, wherein the labeling agent comprises a radionuclide. 399. The method of embodiment 390, wherein the detecting is performed during or related to surgery or resection. 400. A method of detecting and removing a low-grade tumor in an individual comprising the steps of: k) administering a chlorotoxin conjugate to the individual, wherein the chlorotoxin conjugate binds to the low-grade tumor; and l) imaging, visualizing, or analyzing the bound chlorotoxin conjugate, and removing the tissue bound by the chlorotoxin conjugate. 401. The method of embodiment 390, wherein the low-grade tumor selected from the group consisting of: m) a low-grade tumor in or from brain tissue; n) a low-grade tumor in or from subcutaneous fatty tissue; and o) a low-grade tumor in or from breast or mammary tissue. 402. A method for detecting a tumor in an individual comprising the steps of: p) administering a chlorotoxin conjugate to the individual wherein the chlorotoxin conjugate binds to the tumor, and wherein the chlorotoxin conjugate is administered in an amount of between about 3 mg to about 6 mg; and q) imaging, visualizing, or analyzing the bound chlorotoxin conjugate. 403. The method of embodiment 402, wherein the detecting comprises in vivo, or ex vivo detection. 404. The method of embodiment 403, wherein the imaging, visualizing, or analyzing comprises visualizing the chlorotoxin conjugate optically. 405. The method of embodiment 404, wherein the imaging, visualizing, or analyzing comprises in vivo, or ex vivo imaging, visualizing, or analyzing. 406. The method of embodiment 404, wherein the imaging, visualizing, or analyzing comprises optically imaging the tumor. 407. The method of embodiment 402, wherein the chlorotoxin conjugate comprises one or more labeling agents. 408. The method of embodiment 407, wherein the labeling agent comprises a fluorescent moiety. 409. The method of embodiment 408, wherein the fluorescent moiety comprises a near infrared fluorescent moiety. 410. The method of embodiment 407, wherein the labeling agent comprises a radionuclide. 411. The method of embodiment 402, wherein the detecting is performed during or related to surgery or resection. 412. The method of embodiment 411, wherein the tumor, or a portion thereof, is removed during or related to surgery. 413. A method of detecting and removing a tumor in an individual comprising the steps of: r) administering a chlorotoxin conjugate to the individual, wherein the chlorotoxin conjugate binds to the tumor, and wherein the chlorotoxin conjugate is administered in an amount of between about 0.9 mg/m² to about 1.1 mg/m²; s) imaging, visualizing, or analyzing the bound chlorotoxin conjugate, and t) removing the tissue bound by the chlorotoxin conjugate. 414. A method of detecting and removing a tumor in an individual comprising the steps of: u) administering a chlorotoxin conjugate to the individual, wherein the chlorotoxin conjugate binds to the tumor, and wherein the chlorotoxin conjugate is administered in an amount of between about 3 mg to about 6 mg; v) imaging, visualizing, or analyzing the bound chlorotoxin conjugate, and w) removing the tissue bound by the chlorotoxin conjugate. 415. The method of any of the preceding embodiments, wherein the chlorotoxin conjugate comprises a chlorotoxin and a detectable label. 416. The method of embodiment 415, wherein the chlorotoxin comprises a sequence having at least 85% sequence identity to the sequence of MCMPCFTTDHQMARXCDDCCGGXGRGXCYGPQCL-CR, wherein X is selected from K, A and R. 417. The method of embodiment 415 or 416, wherein the detectable label comprises a fluorescent moiety. 418. The method of embodiment 417, wherein the fluorescent moiety comprises a near infrared fluorescent moiety. 419. The method of embodiment 415, wherein the detectable label comprises a radionuclide. 420. The method of embodiment 415, wherein the detectable label comprises a near-infrared dye. 421. The method of embodiment 415, wherein the detectable label comprises a cyanine dye. 422. The peptide of embodiment 420, wherein the near-infrared dye selected from the group consisting of Cy5.5, DyLight 750, indocyanine green (ICG) and IRdye 800. 423. The method of any one of the preceding embodiments, wherein the detecting comprises in vivo, or ex vivo detection. 424. The method of any one of embodiments 367-423, wherein the imaging, visualizing, or analyzing the bound chlorotoxin conjugate is performed on a sample. 425. The method of any one of embodiments 367-424, wherein the imaging, visualizing, or analyzing comprises visualizing the chlorotoxin conjugate optically. 426. The method of any one of embodiments 367-425, wherein the imaging, visualizing, or analyzing comprises optically imaging the tumor. 427. The method of embodiment 426, wherein the tumor is a sarcoma. 428. The method of embodiment 427, wherein the sarcoma is a soft-tissue sarcoma. 429. The method of any one of embodiments 367-428, wherein the chlorotoxin conjugate comprises one or more labeling agents. 430. The method of embodiment 428, wherein the soft-tissue sarcoma is in subcutaneous fatty tissue. 431. The method of any one of embodiments 367-430, wherein the detecting is performed during or related to surgery or resection. 432. The method of any one of embodiments 367-431, wherein the tumor can be differentiated from adjacent or uninvolved tissue with about 90% sensitivity and about 90% specificity. 433. The method of any one of embodiments 367-432, wherein the tumor can be differentiated from adjacent or uninvolved tissue with at least 94% sensitivity and about 100% specificity. 434. The method of embodiment 432 or 433, wherein the tumor is a sarcoma. 435. The method of embodiment 434, wherein the sarcoma is a soft-tissue sarcoma. 436. The method of any one of embodiments 367-435, wherein the tumor selected from the group consisting of: x) a tumor in or from brain tissue; y) a tumor in or from subcutaneous fatty tissue; and a tumor in or from breast or mammary tissue. 437. The method of embodiment 436, wherein the tumor of a), b) or c) is a low-grade tumor. 438. The method of any one of embodiments 367-437, wherein the chlorotoxin conjugate comprises a chlorotoxin and a detectable label. 439. The method of embodiment 438, wherein the chlorotoxin comprises a sequence having at least 85% sequence identity to the sequence of MCMPCFTTDHQMARXCDDCCGGXGRGXCYGPQCL-CR, wherein X is selected from K, A and R. 440. The method of embodiment 438, wherein the detectable label comprises a fluorescent moiety. 441. The method of embodiment 440, wherein the fluorescent moiety comprises a near infrared fluorescent moiety. 442. The method of embodiment 438, wherein the detectable label comprises a radionuclide. 443. The method of embodiment 438, wherein the detectable label comprises a near-infrared dye. 444. The method of embodiment 438, wherein the detectable label comprises a cyanine dye. 445. The peptide of embodiment 443, wherein the near-infrared dye selected from the group consisting of Cy5.5, DyLight 750, indocyanine green (ICG) and IRdye 800. 446. The method of any one of embodiments 367-445, wherein the detecting comprises in vivo, or ex vivo detection. 447. The method of any one of embodiments 367-446, wherein the imaging, visualizing, or analyzing the bound chlorotoxin conjugate is performed on a sample. 448. The method of any one of embodiments 367-447, wherein the imaging, visualizing, or analyzing comprises visualizing the chlorotoxin conjugate optically. 449. The method of any one of embodiments 367-448, wherein the chlorotoxin conjugate comprises one or more labeling agents. 450. The method any one of embodiments 367-449, wherein the detecting is performed during or related to surgery or resection. 451. A method of detecting soft-tissue sarcoma in an individual comprising: administering a chlorotoxin conjugate to the individual, wherein the chlorotoxin conjugate comprises a detectable agent and a chlorotoxin polypeptide having at least 85% sequence identity with MCMPCFTTDHQMARXCDDCCGGXGRGXCYGPQCL- CR; binding the chlorotoxin conjugate to the soft-tissue sarcoma; and detecting the bound chlorotoxin conjugate, wherein an elevated level of bound chlorotoxin conjugate indicates the presence of soft-tissue sarcoma. 452. The method of embodiment 367, wherein the administration of the chlorotoxin conjugate prevents the spread of or metastasis of the tumor. 453. The method of embodiment 368, wherein the chlorotoxin conjugate comprises a chemotherapeutic, an anti-cancer agent, or an anti-cancer drug. 454. The method of embodiment 367, wherein the chlorotoxin conjugate is administered in conjunction with detecting a central or primary tumor. 455. The method of embodiment 371, wherein the administration of the chlorotoxin conjugate prevents the spread of or metastasis of the tumor. 456. The method of embodiment 372, wherein the chlorotoxin conjugate comprises a chemotherapeutic, an anti-cancer agent, or an anti-cancer drug. 457. The method of embodiment 371, wherein the chlorotoxin conjugate is administered in conjunction with detecting a central or primary tumor. 458. The method of embodiment 376, wherein the administration of the chlorotoxin conjugate prevents the spread of or metastasis of the tumor. 459. The method of embodiment 376, wherein the chlorotoxin conjugate comprises a chemotherapeutic, an anti-cancer agent, or an anti-cancer drug. 460. The method of embodiment 376, wherein the chlorotoxin conjugate is administered in conjunction with detecting a central or primary tumor.

EXAMPLES

The invention is further illustrated by the following non-limiting examples.

Example 1

Stability of Compound 16 with Ammonium Acetate Salt

Compound 16

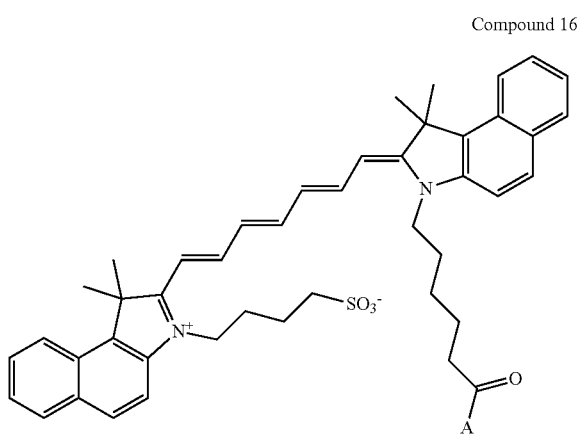

A=MCMPCFTTDHQMARRCDDCCGG RGRGKCYGPQCLCR (K-27 is Point of Attachment)

This example demonstrates the production and stability of Compound 16 under various pH and temperature storage conditions over time.

The peptide portion of Compound 16 is a targeting peptide (modified chlorotoxin) conjugated to the fluorescent dye. The targeting peptide binds selectively to cancerous cells and the dye portion facilitates detection via imaging. The peptide is a 36 amino acid modified chlorotoxin (having a sequence of H-Met-Cys-Met-Pro-Cys-Phe-Thr-Thr-Asp-His-Gln-Met-Ala-Arg-Arg-Cys-Asp-Asp-Cys-Cys-Gly-Gly-Arg-Gly-Arg-Gly-Lys-Cys-Tyr-Gly-Pro-Gln-Cys-Leu-Cys-Arg-OH) wherein two of three lysine amino acids in native chlorotoxin are substituted with arginine (K15R and K23R) to facilitate the subsequent conjugation with a fluorophore to the single remaining lysine (K27) residue resulting in a mono-labeled fluorescent active pharmaceutical ingredient.

Methods and Results: Product solutions were stored at ≤8° C. during manufacturing. All analysis utilized the in-process HPLC method PR to determine the stability of the product in the different buffers.

Dye Conjugation: 500 mg of the peptide portion of Compound 16:(TFA salt), (net peptide content 76.7, net peptide 384 mg, 0.095 mmol) were dissolved in a solution of sodium bicarbonate. DMSO and 140 mg of ICG-Sulfo-ATT dissolved in dried DMSO (net dye 126 mg 0.152 mmol, 1.6 eq. based on a product activity of 90%) were added, resulting in a final reaction volume of approximately 200 mL. The reaction was followed by RP-HPLC and considered completed after 3 hours, with ~3.4% un-reacted Compound 16 remaining.

Ammonium Bicarbonate Purification: The reaction solution was filtered and then diluted with 400 mL of water. The solution was loaded on an RP-HPLC column equilibrated with 0.1M ammonium bicarbonate, and the product recovered by applying a linear gradient of acetonitrile.

The product eluted as a single peak. Fractions were collected and analyzed by analytical HPLC. During analysis the fractions were stored at ≤8° C. protected from light.

The purity, estimated concentration, and estimated amount of product in each fraction are reported in Table 15. The estimation was based on the peak area observed during release analysis of a solution of the product at a concentration of 1 mg/mL in water.

TABLE 15

| Ammonium Bicarbonate Purification Part I | | | |
|---|---|---|---|
| Fraction Number | Purity (%) | Concentration (mg/mL) | Amount (mg) |
| 6-1-3 | 5.48 | 0.0025 | 0.1 |
| 6-1-4 | 73.36 | 0.0970 | 4.8 |
| 6-1-5 | 98.67 | 1.2638 | 63.2 |
| 6-1-6 | 98.96 | 3.0056 | 150.3 |
| 6-1-7 | 95.59 | 2.0464 | 102.3 |
| 6-1-8 | 92.16 | 1.0622 | 53.1 |
| 6-1-9 | 81.87 | 0.3959 | 19.8 |
| 6-1-10 | 66.56 | 0.0703 | 3.5 |
| Total product recovery in fractions 3 to 10 | | | 303 |
| Product recovery in main pool (fractions 5 to 8) | | | 282 |

The main pool (fractions 6-1-5 to 6-1-8, purity 97%) was combined and transferred to the salt exchange step. Samples of the main pool were analyzed for a period of 5 day of storage protected from light at ≤8° C. The material was stable under these conditions.

Ammonium Acetate Salt Exchange: The primary purification main pool solution (~200 mL) was diluted with 100 mL of water and loaded on an RP-HPLC column equilibrated with 0.1M ammonium bicarbonate. Following loading of the sample, the column was equilibrated with 4 bed volumes of 0.1M ammonium acetate adjusted to pH 7.6 with ammonium hydroxide. Finally the column was equilibrated with 0.01M ammonium acetate pH 7.6 and the product was recovered by applying a linear gradient of 0.01M ammonium acetate pH 7.6 in 75% Acetonitrile.

The product eluted as a single peak at approximately 39% acetonitrile concentration. The fractions were collected and analyzed by analytical HPLC. During analysis, the fractions were stored at <8° C. protected from light.

The purity, estimated concentration, and estimated amount of product in each fraction are reported in Table 16. The estimation was based on the peak area observed during release analysis of a solution of the product at a concentration of 1 mg/mL in water.

TABLE 16

Ammonium Bicarbonate Purification Part II

| Fraction Number | Purity (%) | Concentration (mg/mL) | Amount (mg) |
|---|---|---|---|
| 7-1-1 | 79.1 | 0.020084 | 1.0 |
| 7-1-2 | 98.6 | 1.115285 | 55.8 |
| 7-1-3 | 99.0 | 1.804414 | 90.2 |
| 7-1-4 | 98.1 | 1.198464 | 59.9 |
| 7-1-5 | 94.8 | 0.425017 | 21.3 |
| 7-1-6 | 84.2 | 0.101113 | 5.1 |
| 7-1-7 | 65.4 | 0.037211 | 1.9 |
| 7-1-8 | 55.5 | 0.021173 | 1.1 |
| Total product recovery in fractions 3 to 10 | | | 236 |
| Product recovery in main pool (fractions 5 to 8) | | | 232 |

The main pool (fractions 7-1-2 to 7-1-6, purity 97.2%) were combined and transferred to lyophilization. Samples of the main pool were analyzed for a period of 5 day of storage protected from light at ≤8° C. The material was stable under these conditions. Dilution with a volume equal to approximately half the main pool volume provided a stable solution without the presence of a precipitate. This dilution was utilized at the preparative scale.

Lyophilization: The main pool at stage 7 was diluted with 100 mL of water and lyophilized over a period of 4 days using a bottle lyophilizer. There was no problem with solubility after dilution as had been observed with the ammonium bicarbonate main pool; a sample was diluted to 15% acetonitrile without any observed precipitation. During lyophilization, the product formed a stable self-supporting cake.

Reconstitution: The product was readily soluble in water at 1, 5 and 10 mg/mL. Water was selected as the reconstitution solution. Additionally, an LC-MS analysis was performed on the final material.

A sample of the main pool of Stage 6 (ammonium bicarbonate purification) was stored without dilution at ≤8° C. for 5 days protected from light. The sample was analyzed daily. Results are reported in Table 17. The results indicate a low level of instability.

TABLE 17

Stage 6 Main Pool Stability

| Time point (hour) | Purity (%) |
|---|---|
| 0 | 96.6 |
| 26 | 96.4 |
| 48 | 96.4 |
| 72 | 96.3 |
| 105 | 95.7 |
| 191 | 95.4 |

A sample of the main pool of Stage 7 (ammonium acetate purification) was stored without dilution at ≤8° C. for 5 days protected from light. The sample was analyzed daily. Results are reported in Table 18. The results indicate a low level of instability.

TABLE 18

Stage 7 Main Pool Stability

| Time point (hour) | Purity (%) |
|---|---|
| Zero | 97.8 |
| 26 | 97.6 |
| 48 | 97.4 |
| 79 | 97.1 |
| 91 | 96.8 |
| 610 | 96.4 |

An optimized and scalable conjugation procedure for production of Compound 16 for GMP manufacturing was developed. Two different dye reagents were evaluated: ICG-Sulfo-NHS ester and ICG-Sulfo-ATT (both resulting in Compound 16). Design of Experiments (DOE) studies was prepared.

After conjugation of Compound 16, the crude peptide conjugate was purified by RP-HPLC with a TFA and acetonitrile gradient elution. Fractions were characterized for purity with a RP-HPLC assay, pooled and desalted into acetate by HPLC prior to lyophilization to bulk conjugate product.

Compound 16 was stable for up to 14 days at pH 7.5 and 8.5 when stored in the dark at 4° C. in 10 mM Tris, 5% Dextrose and is sensitive to low pH and temperatures above 4° C.

Example 2

Evaluation of the Stability of Compound 16 in Various Buffers and at Various pHs

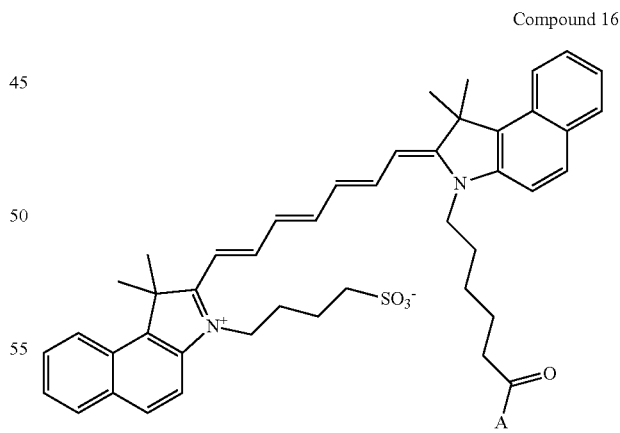

Compound 16

A=MCMPCFTTDHQMARRCDDCCGGRGR GKCYGPQCLCR (K-27 is Point of Attachment)

This example shows the stability of Compound 16 with respect to pH and provides an evaluation of the use of alternative buffers and various excipients and configurations.

This example further shows that various classes of excipients protect Compound 16 from thermal, photo, oxidative and freeze/thaw stress.

In some cases, formulations were stored in microcentrifuge tubes with an air atmosphere and assayed after 2 d and 5 d at 40° C. in the dark, after 3 d at room temperature (rt) in the dark (dk) or in ambient light (lt), and after 3× freeze thaw (F/T) between −20° C. and room temperature in the dark. Formulations were evaluated by visual examination, centrifugation, RP-HPLC, concentration by $A_{786}$, pH, and SDS-PAGE.

In some cases, the timepoints were 4, 7, and 14 days at room temperature with evaluation by visual examination, centrifugation, RP-HPLC, concentration by $A_{786}$, pH, and SDS-PAGE. Where extra material remained, additional stressing conditions were evaluated for further information. The formulations were contained in microcentrifugation tubes in an air environment.

Methods: The following stock solutions were prepared and passed through a 0.2 μm filter (Table 19). Dialysis buffers were prepared immediately before use by combining a stock from Table 19 with sparged water (sparged by bubbling with argon for 15 min 3 h).

TABLE 19

Stock Buffer Solutions

| Buffer | Molarity | pH |
| --- | --- | --- |
| Tris | 0.5 | 7.0, 7.5, 8.0, 8.5 |
| His | 0.25 | 5.5, 6.5, 7.0 |
| maleic acid | 0.5 | 7.0 |
| HEPES | 0.5 | 7.0 |
| EDA | 0.5 | 7.0 |
| acetic | 0.5 | 4.5 |

Compound 16 was prepared at 3 mg/mL in water (see concentration by $A_{786}$ below). Slide-a-lyzer cassettes were pre-soaked in water, then the Compound 16 was dispensed into the cassettes (~11 mL for formulation 1, ~5 mL for formulations 2-6, ~2.7 mL for formulations 7-12). The cassettes were placed into beakers containing 550 mL of the corresponding formulation buffer. Samples were formulated by dialyzing with stirring in the dark at room temperature (on a multiposition stir plate, covered with a box covered with aluminum foil). Dialysis buffer was changed after 1 h, again after 1.25 h, and allowed to continue overnight.

For some formulations, the formulation was placed in a fresh tube and combined with additional sterile 0.25M or 0.5M buffer stock to yield a new formulation with 30 mM concentration of buffer. All formulations were then dispensed into 1.5 mL microcentrifuge tubes, 0.5 mL per tube.

The designed stability timepoints were 4, 7, and 14 days at room temperature. Where extra material remained, additional testing was performed. One tube of each formulation was assayed immediately ("t0"). For additional information, remaining material from these t0 tubes was then frozen at −20° C., then thawed at 5° C., and assayed for pH and concentration ("1×F/T"). Other tubes were incubated in the dark at room temperature (approximately 22-23° C.). A tube was removed and assayed at 4, 7, and 14 d room temperature (rt) ("4 d rt", "7 d rt", "14 d rt"). For additional information, after the 7 d room temperature sample was assayed, the remaining material was placed at room temperature in the light for one day and then assayed again ("7+1 d light"). These tubes were placed on their sides on the benchtop. Stability samples were assayed by visual inspection, centrifugation, RP-HPLC, $A_{786}$, pH, and, in some cases, SDS-PAGE.

Samples were examined visually for clarity, color, and visible particulates. They were then mixed, withdrawn into glass Pasteur pipets, and examined again. Samples were centrifuged ~10,000 rpm for ~2 min. Samples were then examined visually for any visible pellet.

Samples were analyzed by RP-HPLC using the Zorbax_10 method.

TABLE 20

Tested Formulations

| # | Composition | pH |
| --- | --- | --- |
| 1,(1B) | 10, (30) mM Tris | 7.0 |
| 2,(2B) | 10, (30) mM His | 7.0 |
| 3 | 10 mM maleic acid | 7.0 |
| 4, (4B) | 10, (30) mM EDA | 7.0 |
| 6, (6B) | 10, (30) mM HEPES | 7.0 |
| 7 | 10 mM acetic | 4.5 |
| 8 | 10 mM His | 5.5 |
| 9 | 10 mM His | 6.5 |
| 10 | 10 mM Tris | 7.5 |
| 11 | 10 mM Tris | 8.0 |
| 12 | 10 mM Tris | 8.5 |

100 μl of sample was placed in an HPLC vial insert, placed in an amber HPLC vial, and held at 2-8° C. before the 2 μl injection. The formulation buffer was injected twice at the beginning of each run, and a matched formulation buffer blank was run each time before injection of a sample in a new buffer.

The spectrophotometer was blanked with matching formulation buffer. Concentration was calculated using the extinction coefficient. The pH was measured using a calibrated micro pH electrode.

Samples were prepared per the manufacturer's recommendations and then heated at 70° C. for 10 min. 2 μg in 10 μL was loaded onto the SDS-PAGE gels and then run at 200V for approximately 35 min. After electrophoresis, the gels were washed in water for 5 min at room temperature, 3 times. Then they were stained at room temperature for 1.5 h, destained in water overnight, and then destained again with water and imaged on the same day.

Results. Formulations were produced by dialyzing a stock of Compound 16 at 3 mg/mL in water into various buffers. The formulations were then dispensed into microcentrifuge tubes, in air, and stored in the dark at room temperature for up to 14 days. The results from visual examination of the formulations are given in Table 21.

TABLE 21

| Formulation | | | Visual Days at rt | | | | |
|---|---|---|---|---|---|---|---|
| # | Composition | pH | 0 | 4 | 7 | 14 | 7+1d light |
| 1 | 10 mM tris | 7.0 | CGN | CGN | CGN | CGN | CGN |
| 2 | 10 mM His | 7.0 | CGN | CGN | CGF | CGN | CGF |
| 2B | 30 mM His | 7.0 | CGF | CGF | CGF | CGN | nt |
| 3 | 10 mM maleic acid | 7.0 | insoluble | nt | nt | nt | nt |
| 4 | 10 mM EDA | 7.0 | CGN | CGF | CGN | CGF | CGN |
| 6 | 10 mM HEPES | 7.0 | CGF | CGN | CGN | CGN | CGN |
| 6B | 30 mM HEPES | 7.0 | CGN | CGF | CGF | CGN | Nt |
| 7 | 10 mM acetic | 4.5 | CGN | CGF | CGN | CGN | CGN |
| 8 | 10 mM His | 5.5 | CGN | CGN | CGN | CGN | CGN |
| 9 | 10 mM His | 6.5 | CGF | CGN | CGN | CGN | CGN |
| 10 | 10 mM tris | 7.5 | CGF | CGF | CGN | CGF | nt |
| 11 | 10 mM tris | 8.0 | CGN | CGN | CGN | CGN | CGF |
| 12 | 10 mM tris | 8.5 | CGF | CGF | CGF | CGF | CGF |

Visual Inspection.
C = clear;
G = emerald green;
N = essentially no visible particles;
F = very few particles or fibers visible;
nt = not tested.

The results after centrifugation are provided in Table 22. The pH measurements are given in Table 23.

TABLE 22

Pellet Analysis after Centrifugation.

| Formulation | | | Centrifugation Days at rt | | |
|---|---|---|---|---|---|
| # | Composition | pH | 7 | 14 | 7 + 1d light |
| 1 | 10 mM tris | 7.0 | N | N | N |
| 2 | 10 mM His | 7.0 | N | N | N |
| 4 | 10 mM EDA | 7.0 | N | N | N |
| 6 | 10 mM HEPES | 7.0 | N | N | N |
| 6B | 30 MM HEPES | 7.0 | N | N | nt |
| 7 | 10 mM acetic | 4.5 | N | N | N |
| 8 | 10mM His | 5.5 | N | N | N |
| 9 | 10mM His | 6.5 | N | N | N |
| 10 | 10mM tris | 7.5 | P | P | nt |
| 11 | 10mM tris | 8.0 | P | P | P |
| 12 | 10mM tris | 8.5 | P | P | P |

TABLE 23 pH stability analysis.

| Formulation | | | pH Days at rt | | | F/T | |
|---|---|---|---|---|---|---|---|
| # | Composition | pH | 4 | 7 | 14 | 1X F/T | Buffer alone |
| 1 | 10 mM tris | 7.0 | 7.0 | 6.8 | 6.8 | 6.9 | 7.0 |
| 2 | 10 mM His | 7.0 | 6.9 | 6.8 | 6.9 | 6.8 | 6.9 |
| 2B | 30 mM His | 7.0 | 6.9 | 6.8 | 6.9 | 6.8 | nt |
| 4 | 10 mM EDA | 7.0 | 6.6 | 6.6 | 6.6 | 6.6 | 6.7 |
| 6 | 10 mM HEPES | 7.0 | 7.0 | 6.9 | 7.0 | 7.0 | 6.9 |
| 6B | 30 MM HEPES | 7.0 | 7.0 | 6.9 | 6.9 | 6.9 | nt |
| 7 | 10 mM acetic | 4.5 | 4.6 | 4.6 | 4.6 | 4.6 | 4.5 |
| 8 | 10 mM His | 5.5 | 5.4 | 5.3 | 5.4 | 5.3 | 5.4 |
| 9 | 10 mM His | 6.5 | 6.4 | 6.4 | 6.4 | 6.4 | 6.4 |
| 10 | 10 mM tris | 7.5 | 7.4 | 7.3 | 7.4 | 7.4 | 7.4 |
| 11 | 10 mM tris | 8.0 | 7.9 | 7.8 | 7.9 | 7.8 | 7.9 |
| 12 | 10 mM tris | 8.5 | 8.3 | 8.3 | 8.3 | 8.3 | 8.4 |

The % main peak by RP-H PLC is given in Table 24. Stability drops off rapidly at pH≤6.5.

TABLE 24

% Main Peak by RP-HPLC;

| Formulation | | | % Main peak Days at rt | | | |
|---|---|---|---|---|---|---|
| # | Composition | pH | 0 | 4 | 7 | 14 |
| 1 | 10 mM tris | 7.0 | 97.9% | 96.8% | 95.5% | 93.5% |
| 2 | 10 mM His | 7.0 | 98.0% | 96.1% | 94.8% | 90.3% |
| 2B | 30 mM His | 7.0 | 97.7% | 96.2% | 94.7% | 91.9% |
| 4 | 10 mM EDA | 7.0 | 98.3% | 97.1% | 96.2% | 94.6% |
| 6 | 10 mM HEPES | 7.0 | 97.0% | 96.6% | 94.2% | 91.0% |
| 6B | 30 mM HEPES | 7.0 | 97.6% | 96.2% | 94.9% | 92.6% |
| 7 | 10 mM acetic | 4.5 | 92.6% | 64.8% | 47.4% | 21.6% |
| 8 | 10 mM His | 5.5 | 97.1% | 90.9% | 87.1% | 75.8% |
| 9 | 10 mM His | 6.5 | 97.8% | 95.7% | 94.2% | 90.9% |
| 10 | 10 mM tris | 7.5 | 97.7% | 96.7% | 96.0% | 94.0% |
| 11 | 10 mM tris | 8.0 | 97.7% | 97.2% | 96.6% | 93.4% |
| 12 | 10 mM tris | 8.5 | 97.9% | 95.5% | 93.9% | 91.7% |

Δ light v dark = (7 + 1 d light) − (7 d dark).

Figure 1B:
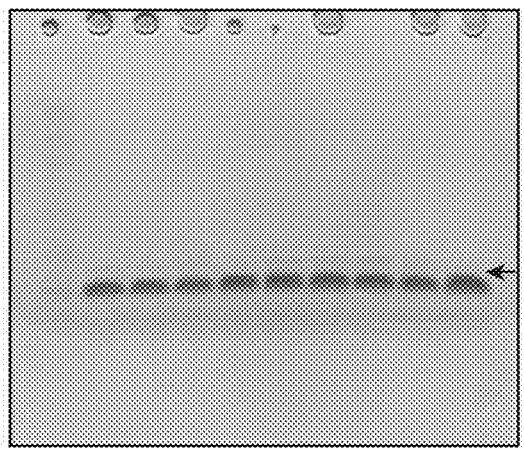
Figure 1C:
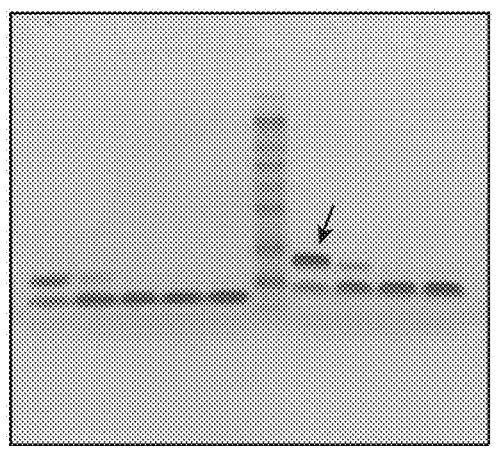

FIG. 1A-FIG. 1C shows SDS-PAGE analysis of the formulations after 14 days at room temperature. FIGS. 1A and 1B show SDS-PAGE analysis of, from left to right, (molecular weight marker) MWM, 1, 2, 2B, 4, 6, 6B, 9, 10 and reference. FIG. 1A was performed with a reducing agent and FIG. 1B was performed without a reducing agent. FIG. 1C shows SDS-PAGE analysis of, from left to right, 7, 8, 11, 12, reference and MWM (no reducing agent). (Reference=Pilot Lot, Sublot #2. MWM: 188 k, 98 k, 62 k, 49 k, 38 k, 28 k, 17 k, 14 k, 6 k, 3 k. Arrow points to a higher molecular weight species.

Compound 16 was formulated by additional means. Stocks were prepared and the pH of some stocks was adjusted to near 6.8 to avoid pH shift upon addition to formulations (Table 25). All stocks were 0.2 μm filtered except BHT, BHA, propyl gallate, and polysorbates. Polysorbate and NaI stocks were stored with an argon blanket. His, Met, NaI, polysorbate, BHT, BHA, and propyl gallate stocks were stored in the dark.

TABLE 25

Stock Buffer Solutions

| Component | mM | pH |
|---|---|---|
| Tris | 500 | 7.5 |
| His | 250 | 7.5 |
| NaCl | 4000 | |
| Met | 200 | ~6.8 |
| EDTA | 200 | ~6.8 |
| Gly | 200 | ~6.8 |
| Component | w/v% | Solvent |
| Mannitol | 10% | $H_2O$ |
| Sucrose | 20% | $H_2O$ |
| Trehalose*2H2O | 22% | $H_2O$ |
| BHT | 2.50% | 10% $H_2O$ in EtOH |
| BHA | 2.50% | 50% EtOH/$H_2O$ |
| Propyl gallate | 2.50% | 25% EtOH in $H_2O$ |
| PS80 | 10% | $H_2O$ |
| PS20 | 10% | $H_2O$ |
| NaI | 20% | $H_2O$ |
| HPCD | 40% | $H_2O$ |
| Captisol | 40% | $H_2O$ |

Compound 16 was prepared at 10 mg/mL in argon-sparged water. The Compound 16 stock was combined with buffer stock, osmolyte stock, and water to make parent stocks A-E containing Compound 16 (Table 26). The pH of each soluble parent stock was adjusted (from starting values of 6.6-6.7) to 6.8 with 0.1N NaOH.

TABLE 26

Parent Stock Formulations

| Parent Stocks | | | Parent Stock composition | | | mLs: | | | |
|---|---|---|---|---|---|---|---|---|---|
| | | | | | | | | Cmpd 16 | |
| | Total mL | Buffer | Buffer mM | Osmolyte | [Osmolyte] | Buffer stock | Osmolyte stock | stock (10 mg/mL) | H2O |
| A | 4.50 | Tris | 11.7 | mannitol | 5.8% | 0.105 | 2.625 | 1.575 | 0.195 |
| B | 24.15 | His | 11.7 | mannitol | 5.8% | 1.127 | 14.088 | 8.453 | 0.483 |
| C | 2.4 | His | 11.7 | sucrose | 11.1% | 0.112 | 1.330 | 0.840 | 0.118 |
| D | 2.4 | His | 11.7 | trehalose | 12.3% | 0.112 | 1.336 | 0.840 | 0.112 |
| E | 0.1 | His | 11.7 | NaCL (mM) | 163.3 | 0.005 | 0.004 | 0.035 | 0.056 |

The final formulations were then created by combining the parent stocks with other excipient stocks and water. The formulations were passed through 0.2 μm sterile syringe filters. 0.4 mL of Formulations 1, 3, 4, and 5 were reserved for "t0" analysis.

Two 0.3 mL tubes were placed in a dark 40° C. incubator for analysis after 2 d and 5 d. The 2 d samples were assayed after 40 h (1.7 d). One 0.3 mL tube was subjected to "3×F/T." 1×F/T comprised freezing the material at −20° C. for at least 8 h, thawing the material at room temperature (rt) in the dark (~1 h), then gently mixing, inverting, and spinning to bring the material back to the bottom of the tube. This cycle was performed a total of three times. The remaining 0.3 mL tube was reserved at 5° C. One of the 0.5 mL tubes was placed in the dark at room temperature and the other 0.5 mL tube was placed in the light at room temperature. For light exposure, the tubes were placed on their side and exposed to ambient light. A volume of 0.5 mL was chosen for light exposure, as previous work had shown 0.3 mL samples are prone to precipitation and degradation after light exposure in this configuration.

Stability samples were assayed by visual inspection, centrifugation, RP-HPLC, $A_{786}$, pH, and, in some cases, SDS-PAGE. Samples were held in the dark at 5° C. when not in use. Samples were examined visually for clarity, color, and visible particulates. Samples were inverted three times and examined again. Samples were gently mixed, then centrifuged ~10,000 rpm for ~2 min. Samples were examined visually for a pellet. Remaining assays were performed on the supernatant.

Samples were prepared per the manufacturer's recommendations and then heated at 70° C. for 10 min. 2.5 μg in 10 μL was loaded onto the SDS-PAGE gels and then run at 165-200V. After electrophoresis, the gels were washed in water for 5 min at room temperature, 3 times. Gels were stained at room temperature for 1 h, destained in water overnight, and then destained again with water and imaged on the same day.

Formulations were produced by dissolving Compound 16 at 10 mg/mL in water, diluting into the buffer and osmolyte, adjusting the pH, adding final additives and water as needed (Table 27).

TABLE 27

Formulations Tested at 3 mg/mL Compound 16 at pH 6.8

| # | Buffer | Osmolyte | [Osm] | Other | [Other] | Parameter examined |
|---|---|---|---|---|---|---|
| 1 | 10 mM Tris | mannitol | 5% | — | | Buffer |
| 3 | 10 mM His | mannitol | 5% | — | | Buffer |
| 4 | 10 mM His | sucrose | 9.5% | — | | Osmolyte |
| 5 | 10 mM His | trehalose | 10.5% | — | | Osmolyte |
| 6 | 10 mM His | NaCl | 140 mM | — | | Ionic strength |
| 7 | 10 mM His | mannitol | 5% | NaCl | 10 mM | Ionic strength |
| 8 | 10 mM His | mannitol | 5% | Met | 10 mM | Antioxidant |
| 9 | 10 mM His | mannitol | 5% | BHT | 0.01% | Antioxidant |
| 10 | 10 mM His | mannitol | 5% | BHA | 0.01% | Antioxidant |
| 11 | 10 mM His | mannitol | 5% | propyl gallate | 0.01% | Antioxidant |

TABLE 27-continued

Formulations Tested at 3 mg/mL Compound 16 at pH 6.8

| # | Buffer | Osmolyte | [Osm] | Other | [Other] | Parameter examined |
|---|--------|----------|-------|-------|---------|---------------------|
| 12 | 10 mM His | mannitol | 5% | EDTA | 1 mM | Antioxidant synergist (metal chelator) |
| 15 | 10 mM His | mannitol | 5% | Gly | 20 mM | Amino acid |
| 16 | 10 mM His | mannitol | 5% | PS80 | 0.02% | Surfactant |
| 17 | 10 mM His | mannitol | 5% | PS20 | 0.02% | Surfactant |
| 19 | 10 mM His | mannitol | 5% | HPCD | 5% | Cyclodextrin |

Formulations #6 (140 mM NaCl), #12 (1 mM EDTA) and #18 (0.2% NaI) had immediate gross precipitation and were discarded. In all other formulations, the material was clear, green, and had no significant visible particle formation at all timepoints tested (Table 28).

TABLE 28

Visual Inspection.

| | Formulation | | | | Visual | | | | |
|---|---|---|---|---|---|---|---|---|---|
| | | | | | | 2 d | 5 d | 3 d | 3 d | 3X |
| # | Buffer | Osmolyte | Other | [Other] | t0 | 40 C. | 40 C. | rt dk | rt lt | FT |
| 1 | Tris | mannitol | — | | CGF | CGN | CGF | CGN | CGN | CGN |
| 3 | His | mannitol | — | | CGN | CGN | CGN | CGN | CGN | CGN |
| 4 | His | sucrose | — | | CGN | CGN | CGN | CGN | CGN | CGN |
| 5 | His | trehalose | — | | CGN | CGN | CGN | CGN | CGN | CGN |
| 6 | His | 140 mM NaCl | — | | insoluble | nt | nt | nt | nt | nt |
| 7 | His | mannitol | NaCl | 10 mM | nt | CGN | nt | nt | nt | CGN |
| 8 | His | mannitol | Met | 10 mM | nt | CGN | CGN | CGN | CGN | CGN |
| 9 | His | mannitol | BHT | 0.01% | nt | CGN | CGN | CGN | CGN | CGN |
| 10 | His | mannitol | BHA | 0.01% | nt | CGN | CGN | CGN | CGN | CGN |
| 11 | His | mannitol | propyl gallate | 0.01% | nt | CGN | CGN | CGN | CGN | CGN |
| 12 | His | mannitol | EDTA | 1 mM | insoluble | nt | nt | nt | nt | nt |
| 15 | His | mannitol | Gly | 20 mM | nt | CGN | CGN | CGF | CGN | CGN |
| 16 | His | mannitol | PS80 | 0.02% | nt | CGN | CGN | CGF | CGN | CGN |
| 17 | His | mannitol | PS20 | 0.02% | nt | CGN | CGN | CGN | CGN | CGN |
| 19 | His | mannitol | HPCD | 5% | nt | CGN | CGN | CGN | CGN | CGN |

C = clear; G = emerald green; N = essentially no visible particles; F = very few particles or fibers visible; P = pellet, nt = not tested.

All samples were at pH 6.8+/−0.1 (Table 29).

TABLE 29 pH

| | Formulation | | | | pH | | | | |
|---|---|---|---|---|---|---|---|---|---|
| | | | | | | 2 d | 5 d | 3 d | 3 d | 3X |
| # | Buffer | Osmolyte | Other | [Other] | t0 | 40 C. | 40 C. | rt dk | rt lt | FT |
| 1 | Tris | mannitol | — | | 6.8 | 6.8 | 6.8 | 6.9 | 6.8 | 6.9 |
| 3 | His | mannitol | — | | 6.8 | 6.8 | 6.8 | 6.9 | 6.8 | 6.8 |
| 4 | His | sucrose | — | | 6.8 | 6.8 | 6.8 | 6.9 | 6.8 | 6.9 |
| 5 | His | trehalose | — | | 6.8 | 6.8 | 6.8 | 6.8 | 6.8 | 6.8 |
| 7 | His | mannitol | NaCl | 10 mM | nt | 6.8 | nt | nt | nt | 6.8 |
| 8 | His | mannitol | Met | 10 mM | nt | 6.8 | 6.8 | 6.8 | 6.8 | 6.8 |
| 9 | His | mannitol | BHT | 0.01% | nt | 6.8 | 6.8 | 6.8 | 6.8 | 6.8 |
| 10 | His | mannitol | BHA | 0.01% | nt | 6.8 | 6.8 | 6.8 | 6.8 | 6.8 |
| 11 | His | mannitol | propyl gallate | 0.01% | nt | 6.8 | 6.7 | 6.9 | 6.8 | 6.8 |
| 15 | His | mannitol | Gly | 20 mM | nt | 6.8 | 6.8 | 6.8 | 6.8 | 6.8 |
| 16 | His | mannitol | PS80 | 0.02% | nt | 6.8 | 6.8 | 6.9 | 6.8 | 6.8 |
| 17 | His | mannitol | PS20 | 0.02% | nt | 6.8 | 6.8 | 6.8 | 6.8 | 6.8 |
| 19 | His | mannitol | HPCD | 5% | nt | 6.8 | 6.8 | 6.8 | 6.8 | 6.8 |

The % main peak by RP-HPLC is given in Table 30.

TABLE 30

% Main Peak by RP-HPLC.

| | | Formulation | | | | % Main Peak | | |
|---|---|---|---|---|---|---|---|---|
| | | | | | | 2 d | 5 d | 3 d | 3X |
| # | Buffer | Osmolyte | Other | [Other] | t0 | 40 C. | 40 C. | rt lt | FT |
| 1 | Tris | mannitol | — | | 97.5% | 93.9% | 85.1% | 73.9% | 97.4% |
| 3 | His | mannitol | — | | 98.5% | 94.0% | 86.1% | 92.6% | 98.6% |
| 7 | His | mannitol | NaCl | 10 mM | nt | 95.3% | nt | nt | 98.3% |
| 8 | His | mannitol | Met | 10 mM | nt | 94.3% | 87.5% | 93.0% | 98.6% |
| 9 | His | mannitol | BHT | 0.01% | nt | 94.1% | 83.4% | 91.2% | 98.7% |
| 10 | His | mannitol | BHA | 0.01% | nt | 93.9% | 84.9% | 91.1% | 98.3% |
| 11 | His | mannitol | propyl gallate | 0.01% | nt | 88.7% | 72.7% | 89.7% | 98.2% |
| 15 | His | mannitol | Gly | 20 mM | nt | 94.4% | 83.9% | 90.9% | 97.7% |
| 16 | His | mannitol | PS980 | 0.02% | nt | 93.4% | 83.8% | 91.9% | 98.6% |
| 17 | His | mannitol | PS20 | 0.02% | nt | 94.4% | 84.3% | 90.3% | 98.3% |
| 19 | His | mannitol | HPCD | 5% | nt | 87.3% | 65.6% | 89.3% | 96.2% |

Δ light vs. dark = % main peak after 3 d room temperature in the light minus % main peak after 3 d room temperature in the dark.

Figure 2B:
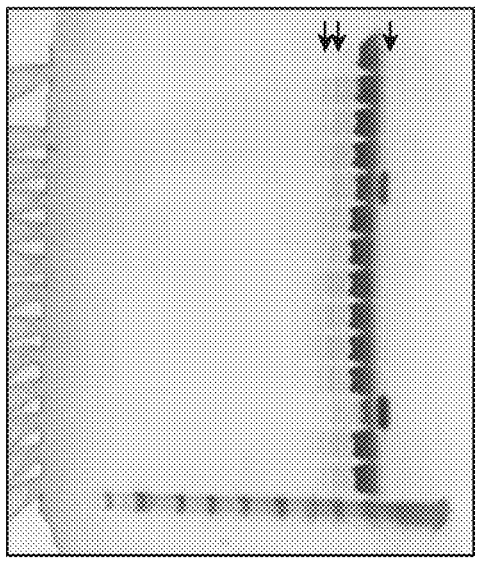
FIG. 2A-FIG. 2C shows SDS-PAGE of chlorotoxin conjugate formulations after 5 days at 40° C. (and t0).
Figure 2C:
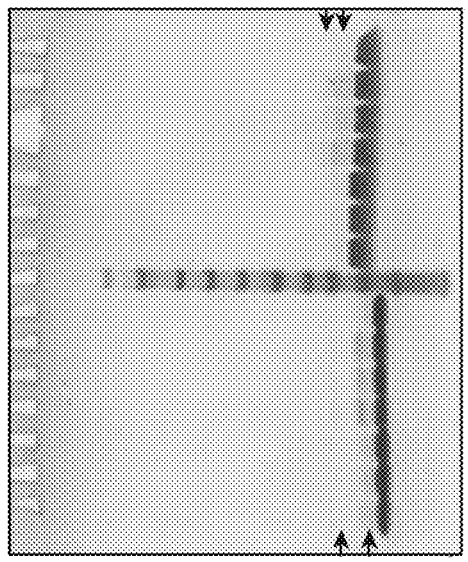
Figure 2A:
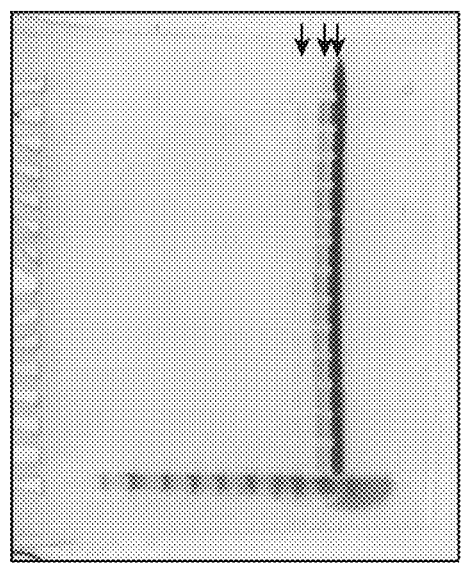

After 5 days at 40° C., formation of significant amounts of higher molecular weight species (HMWS) were visible by reducing and nonreducing SDS-PAGE (FIG. 2A-FIG. 2C). FIG. 2A-FIG. 2C shows SDS-PAGE of formulations after 5 days at 40° C. (and at time=0). Samples are after 5 days at 40° C. unless marked as time=0. Formulations from left to right. FIGS. 2A and 2B show SDS-PAGE analysis of, from left to right, (molecular weight marker) MWM, 3, 4, 5, 8, 9, 10, 11, 13, 14, 15, 16, 17, 19, reference. FIG. 2A was performed with a reducing agent and FIG. 2B was performed without a reducing agent. FIG. 2C shows SDS-PAGE analysis of, from left to right, 1 t0, 3 t0, 5 t0, 1, 2, 3, reference, MWM, 1 t0, 3 t0, 5 t0, 1, 2, 3, reference. For FIG. 2C, lanes to the left of MWM were performed with a reducing agent and lanes to the right of MWM were performed without a reducing agent. Reference=Pilot Lot, Sublot #2 (−20° C.). MWM (top to bottom): 188 k, 98 k, 62 k, 49 k, 38 k, 28 k, 17 k, 14 k, 6 k, 3 k. Black arrows point to higher molecular weight species, green arrow points to new band in formulation 19, and red arrow points to what may be reduced material in formulations 5 and 15.

Figure 3A:
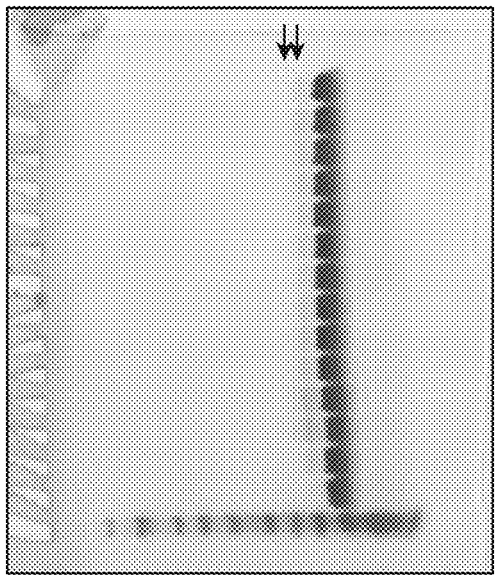
FIG. 3A-FIG. 3C shows SDS-PAGE of chlorotoxin conjugate formulations after 3 days at room temperature in the light or 3×F/T. Samples are after 3 days at room temperature in the light unless marked as F/T
Figure 3B:
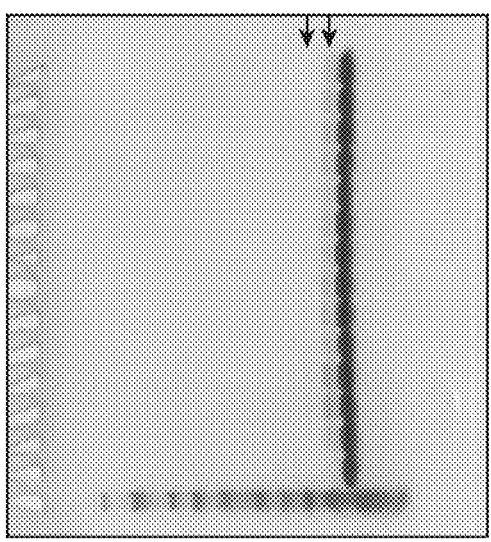
Figure 3C:
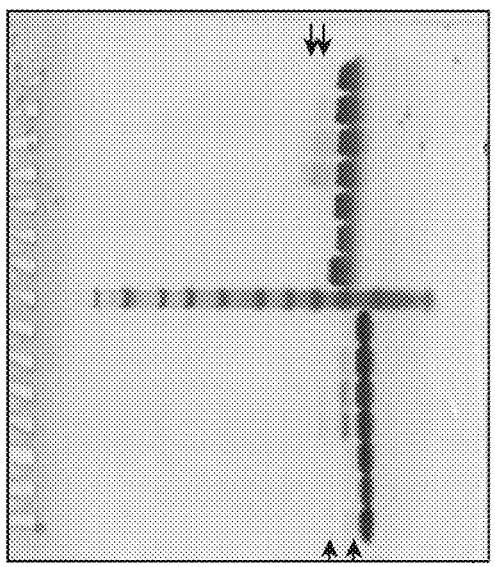

After 3 days at room temperature in the light, higher molecular weight species formation was evident (FIG. 3). Samples are from after 3 days at room temperature in the light unless marked as F/T. FIGS. 2A and 2B show SDS-PAGE analysis of, from left to right, (molecular weight marker) MWM, reference, 3, 4, 5, 8, 9, 10, 11, 13, 14, 15, 16, 17, 19. FIG. 3A was performed with a reducing agent and FIG. 3B was performed without a reducing agent. FIG. 3C shows SDS-PAGE analysis of, from left to right, 3 F/T, 13 F/T, 14 F/T, 1, 2, 3, reference, MWM, 3 F/T, 13 F/T, 14 F/T, 1, 2, 3, reference. For FIG. 3C, lanes to the left of MWM were performed with a reducing agent and lanes to the right of MWM were performed without a reducing agent. Reference=Compound 16, Pilot Lot, Sublot #2 (−20° C.). MWM (top to bottom): 188 k, 98 k, 62 k, 49 k, 38 k, 28 k, 17 k, 14 k, 6 k, 3 k. Black arrows point to HMWS.

The effect of various excipients on Compound 16 stability was tested with Compound 16 in a base buffer. Formulations were stored in microcentrifuge tubes with an air atmosphere and assayed after 2 days and 5 days at 40° C. in the dark, after 3 days at room temperature (rt) in the dark or in ambient light, and after 3× freeze/thaw between −20° C. and room temperature in the dark.

Example 3

Evaluation of Chlorotoxin Conjugate Stability in Various Vial Types and Atmospheres This example describes the stability of Compound 16 in different vial types and in different atmospheric (headspace) environments.

The stability of KNTi-0303 (the active pharmaceutical ingredient of BLZ-100) was tested in amber glass, clear glass, CZ, and Type 1+ glass vials with air or $N_2$ headspace. The purity of samples was assessed by RP-HPLC, as shown in Table 31. All samples degraded significantly upon incubation at 40° C. In some cases, the purity values after 8 d at 40° C. were similar or even higher than the values after 5 d at 40° C. Both the 5 d and 8 d samples were reanalyzed together the following week, and the purity values as well as chromatogram shapes were comparable to the original analyses. The 2 d, 5 d, and 8 d vials were all in the 40° C. incubator on the same days, with the vials being removed after the set number of days, placed at 5° C. in the dark, and then analyzed within 1 d.

TABLE 31

% purity by RP-HPLC of Compound 16 in stored in different vial types.

| | | | | | % purity RP-HPLC | | | | | | | | | |
|---|---|---|---|---|---|---|---|---|---|---|---|---|---|---|
| | | | | 2 d | 5 d | 8 d | | 1 d | 3 d | 1 d | 3 d | 1 d rt | 3 d rt | 3X |
| # | Vial | Atm | t0' | 40 C. | 40 C. | 40 C. | t0 | rt lt | rt lt | rt dk | rt dk | shake | shake | F/T |
| 1 | Amber | Air | 98.7 | 92.2 | 72.6 | 72.9 | 98.8 | 98.2 | 96.8 | 98.0 | 97.6 | nt | nt | nt |
| 2 | Amber | $N_2$ | 98.7 | 94.2 | 75.4 | 80.2 | 98.8 | 98.3 | 98.0 | 98.8 | 98.2 | 98.5 | 97.7 | 98.4 |

TABLE 31-continued

% purity by RP-HPLC of Compound 16 in stored in different vial types.

| | | | % purity RP-HPLC | | | | | | | | | | |
|---|---|---|---|---|---|---|---|---|---|---|---|---|---|
| Configuration | | | 2 d | 5 d | 8 d | | 1 d | 3 d | 1 d | 3 d | 1 d rt | 3 d rt | 3X |
| # Vial | Atm | t0' | 40 C. | 40 C. | 40 C. | t0 | rt lt | rt lt | rt dk | rt dk | shake | shake | F/T |
| 3 Clear | Air | 98.7 | 91.1 | 74.3 | 70.6 | 98.8 | 97.8 | 95.8 | nt | nt | nt | nt | nt |
| 4 Clear | N$_2$ | 98.7 | 95.5 | 85.5 | 84.7 | 98.8 | 98.4 | 97.6 | nt | nt | nt | 98.0 | 98.9 |
| 5 CZ | Air | 98.7 | 93.3 | 74.3 | 72.4 | 98.8 | 97.6 | 95.5 | nt | nt | nt | nt | nt |
| 6 CZ | N$_2$ | 98.7 | 95.9 | 83.1 | 79.6 | 98.8 | 98.3 | 96.7 | nt | nt | nt | 97.7 | 98.9 |
| 7 Type 1+ | Air | 98.7 | 93.8 | 76.2 | 72.3 | 98.8 | 97.6 | 95.8 | nt | nt | nt | nt | nt |
| 8 Type 1+ | N$_2$ | 98.7 | 95.5 | 85.8 | 80.8 | 98.8 | 98.1 | 97.5 | nt | nt | nt | 98.3 | 98.8 |

In all vials stored at 40° C., purity loss by RP-HPLC was significantly slower when samples were stored under N$_2$ rather than air. Under N$_2$, purity loss was significantly more rapid in amber glass vials than in clear glass, Type 1+ glass, or CZ vials. Under air, however, there was not a clear difference between vial types, though degradation may have been slower in Type 1+ glass or CZ vials.

When exposed to light, purity loss by RP-HPLC in all vials was again significantly slower when samples were stored under N$_2$ rather than air. With light exposure, purity loss was slowed by storage in amber glass vials rather than the other vial types. Under N$_2$, purity loss after 3 d in the light (8 h of light exposure per day) was 0.8% in amber glass vials and 1.2% in clear glass vials. Under air, purity loss after 3 d in the light was 2.0% in amber glass vials and 3.0% in clear glass vials. Thus, the improved purity by storage in amber vials after 3 d in the light is 0.4% under N$_2$ and 1.0% in air compared to clear glass vials. Clear glass vials, Type 1+ vials, and CZ vials performed similarly with light exposure except that CZ vials under N$_2$ were less protective than other vials under N$_2$, likely due to the increased gas permeability of CZ vials.

Comparing data from samples at rt in the light versus in the dark shows that the formulation in amber vials undergoes very little degradation due to light exposure over 3 d. After 3 d, the additional purity loss from light exposure was 0.2% under N$_2$ and 0.8% in air.

By RP-HPLC, Compound 16 did not appear very sensitive to shaking in the formulations and configurations tested. Compared to rt storage in the dark without shaking, there was an additional purity loss of 0.5% due to shaking for 3 d in amber vials under N$_2$. There was no clear difference between vial types upon shaking under N2, but the stability may be slightly higher in clear glass or Type 1+ glass vials. Shaking provides agitation stress but also provides additional convection that could increase exposure to oxygen in the headspace or surface leaching.

There was no apparent degradation after 3×F/T in any vial type under N$_2$ as assessed by RP-HPLC. While the value appears slightly lower for the amber vials, the 1$^{st}$ RP-HPLC injection yielded a value of 98.0% but the 2$^{nd}$ injection yielded a value of 98.8%. The 2$^{nd}$ injection was comparable to the other vial types; it is possible the 1$^{st}$ injection was artificially low due to effect of the prior injected sample.

Example 4

Development of Candidate Formulations for Lyophilized Conjugates

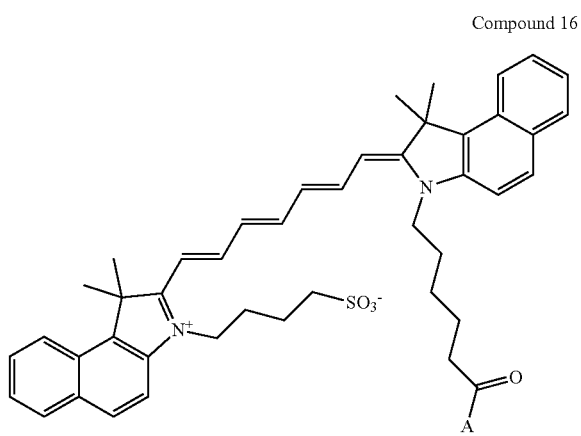

Compound 16

A=MCMPCFTTDHQMARRCDDCCGG RGRGKCYGPQCLCR (K-27 is Point of Attachment)

This example shows various lyophilization conditions for Compound 16.

Methods: Various strategies for lyophilization of Compound 16 were attempted for different formulations of Compound 16. For freezing techniques, 1.2 mL of a formulation was added to 3 mL glass vial and stoppered with single vent fluorotec coated stopper. For fast freezing, vials were placed on a shelf after equilibration of the shelf at −40° C. For slow freezing, the temperature was controlled to reduce from 4° C. to −40° C. at a rate of 1° C./min. The peptide-dye conjugate concentrations used were from 1, 3, 4, 6, and 10 mg/mL.

Lyophilized Compound 16 was reconstituted by addition of 1.2 mL of water and followed with gentle mixing for <1 min. The reconstituted Compound 16 was a clear, emerald green solution with no visible particles and no pellet observed after centrifugation (15,000×g, 5 min). The pH ranged from 6.8-6.95 and the moisture content was <1% as determined by KF titration.

Prior to lyophilization, the formulation volumes were each 1.2 mL and lyophilized formulations were reconstituted with 1.1 mL of water followed by gentle mixing for <1 min. No visible aggregates were observed during or after reconstitution.

Reconstituted samples were analyzed for oxidation/purity by RP-HPLC, mass determined by RP-HPLC and/or OD786, aggregation measured by pellet formation after centrifugation, MFI and/or SDS-PAGE, charge heterogeneity determined by cIEF, secondary structure indicated by FTIR, pH measurements as described herein (the pH ranged from 6.8-7.0) and the KF titration determined (residual moisture was <0.5%).

Figure 4:
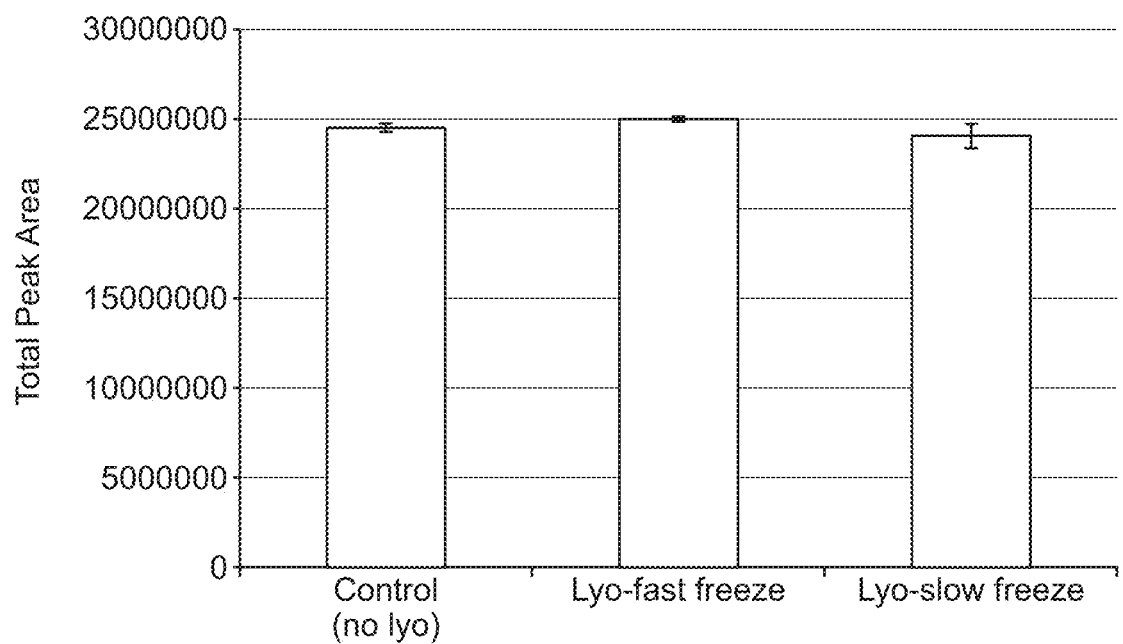
FIG. 4 shows total peak area of RP-HPLC chromatograms for chlorotoxin conjugate formulations with no lyophilization or lyophilization with fast or slow freezing.
Figure 5:
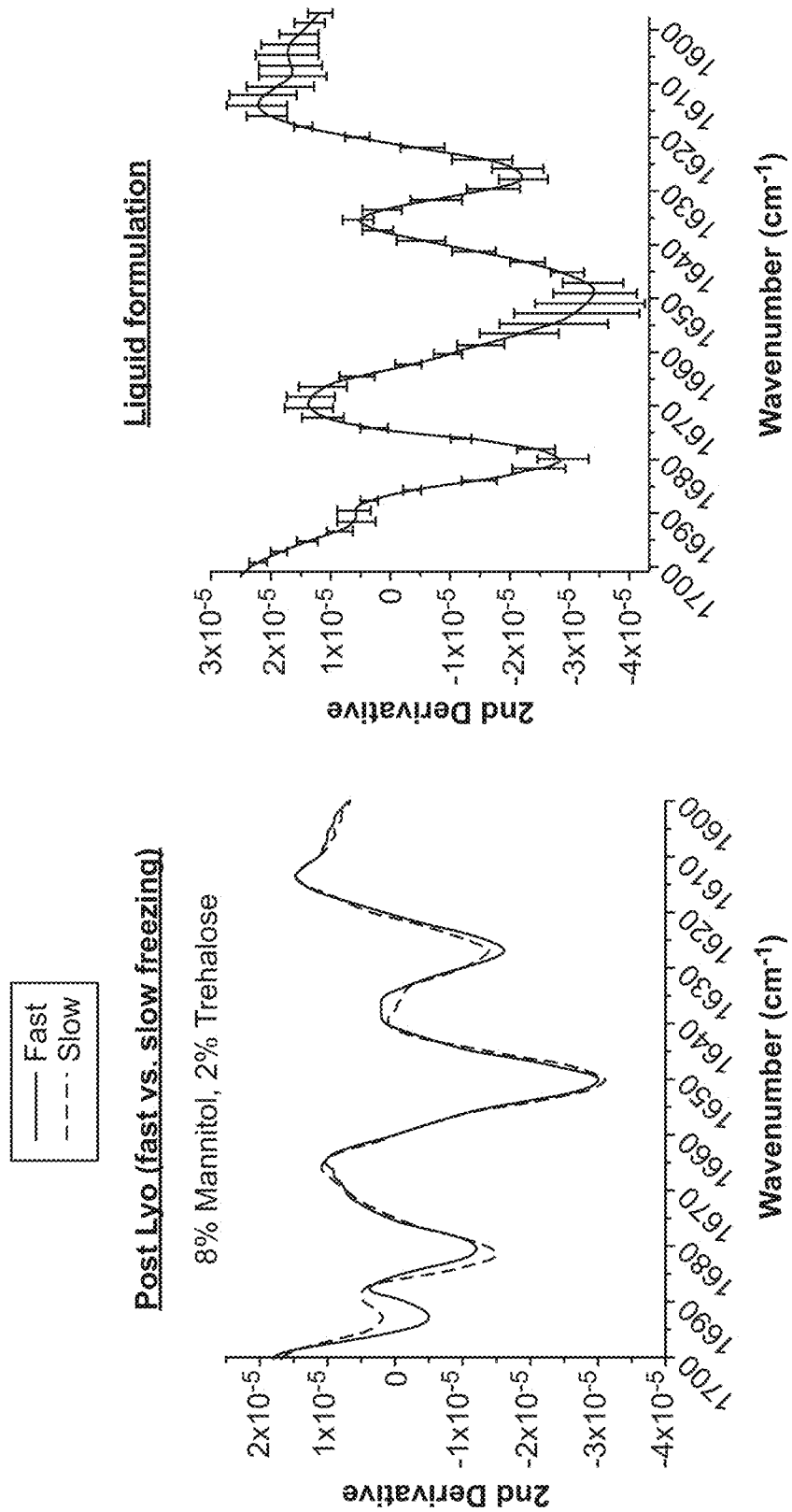
FIG. 5 shows FTIR-derived secondary structures obtained for chlorotoxin conjugate lyophilized with slow versus fast freezing (left) and in a liquid formulation (right).
Figure 6:
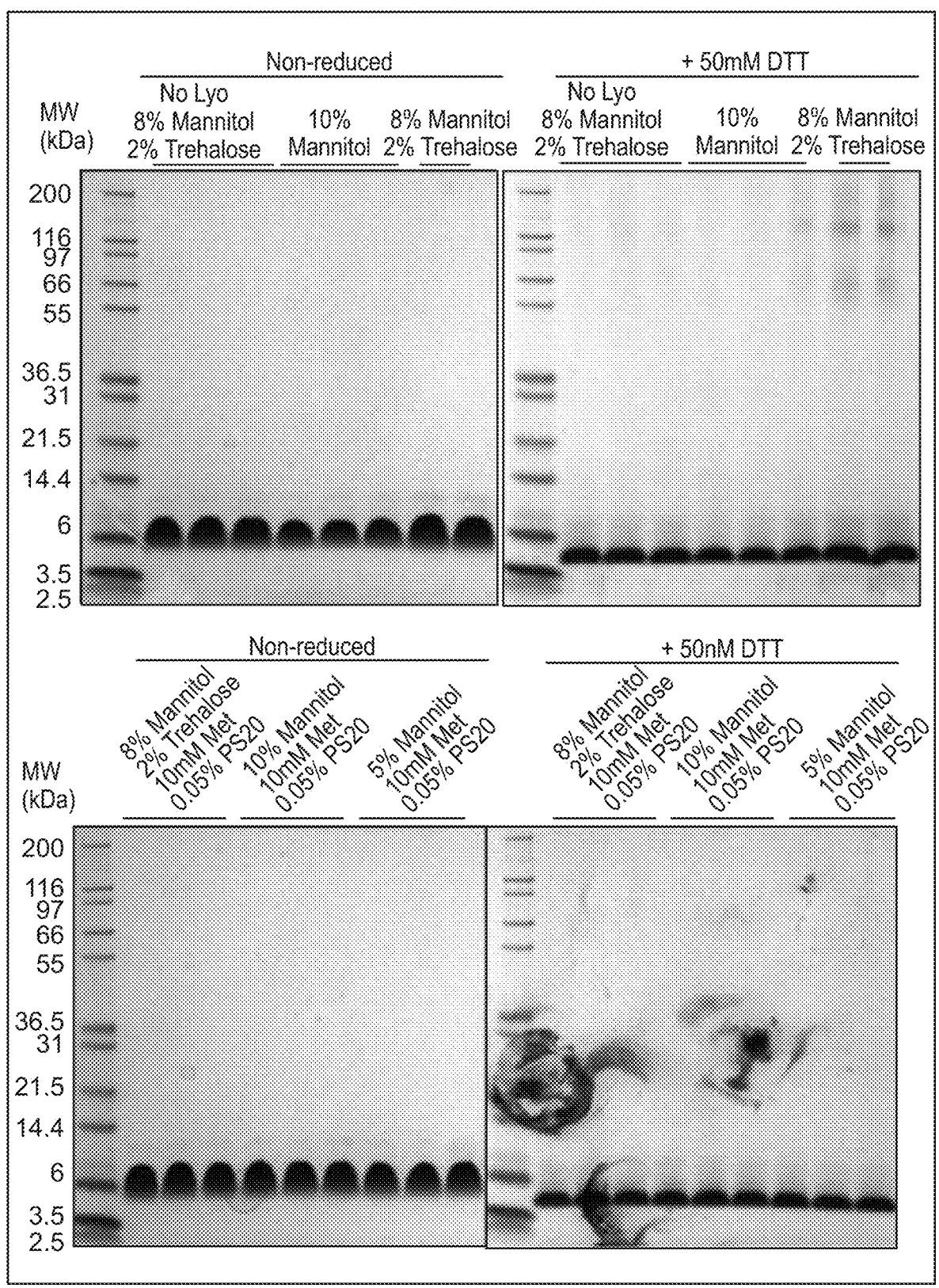
FIG. 6 shows SDS-PAGE analysis of various lyophilized formulations.
Figure 7:
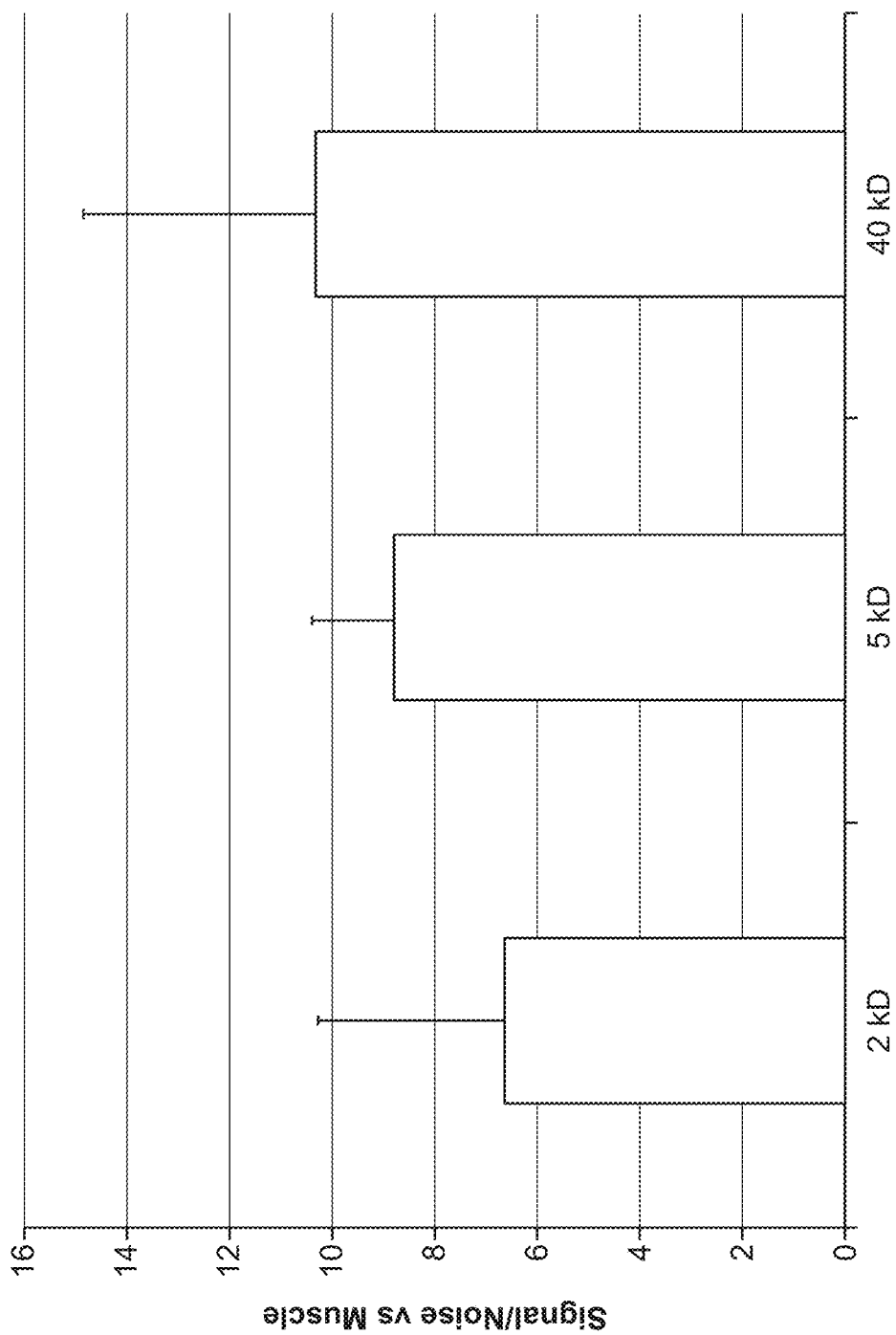
FIG. 7 shows signal-to-noise ratios (SNRs) of chlorotoxin conjugates in U87 flank tumors 24 hours after injection.

Results: Summary data for various lyophilized Compound 16 formulations are provided in Tables 32-33. As determined by RP-HPLC, lyophilization with fast and slow freezing produced no substantial differences in total peak area of chromatograms from formulations with 8% Mannitol and 2% trehalose (FIG. 4). The FTIR spectra of reconstituted samples were comparable to FTIR spectra of samples that had not been lyophilized (Table 33). Secondary structures indicated by FTIR spectra did not differ between formulations that underwent fast versus slow freezing (FIG. 5). No difference in particle size was detected by SDS-PAGE of various lyophilized formulations (FIG. 6). There also was no significant difference in charge heterogeniety between samples (isoelectric point, pI), as determined by cIEF.

TABLE 33

Properties of Formulations.

| # | API Conc (mg/mL) | Formulation | Cake Appearance | pH | FTIR | Intr-FL | Pellet Obs (Y/N) | SDS Page | OD 786 (%) | cIEF Area (%) | RP-HPLC Purity (%) |
|---|---|---|---|---|---|---|---|---|---|---|---|
| 1 | 3 | No Lyo | N/A | 6.96 | NC | NC | N | NC | 98.1 | 95.0 | 98.9 |
| 2 | 3 | 8% Mannitol 2% Trehalose | Intact | 6.75 | NC | NC | N | NC | 112.8 | 95.3 | 98.2 |
| 3 | 3 | 8% Mannitol 2% Trehalose 10 mM Met | Intact | 6.69 | NC | NC | N | NC | 118.5 | 95.6 | 98.4 |
| 4 | 3 | 8% Mannitol 2% Trehalose 20 mM Met | Intact | 6.93 | NC | NC | N | NC | 113.0 | 93.8 | 98.4 |
| 5 | 3 | 8% Mannitol 2% Trehalose 0.05% PS20 | Intact | 6.97 | NC | NC | N | NC | 116.0 | 92.8 | 96.8 |
| 6 | 3 | 8% Mannitol 2% Trehalose 0.05% PS80 | Intact | 6.91 | NC | NC | N | NC | 115.1 | 94.6 | 96.8 |
| 7 | 3 | 8% Mannitol 2% Trehalose 10 mM Met, 0.05% PS20 | Intact | 6.84 | NC | NC | N | NC | 126.4 | 93.7 | 97.2 |
| 8 | 3 | 10% Mannitol 10 mM Met, 0.05% PS20 | Intact | 6.77 | NC | NC | N | NC | 119.4 | 91.8 | 97.1 |
| 9 | 3 | 5% Mannitol 10 mM Met, 0.05% PS20 | Intact | 6.78 | NC | NC | N | NC | 106.7 | 91.3 | 97.2 |
| 10 | 3 | 4% Mannitol 2% Trehalose 10 mM Met, 0.05% PS20 | Intact | 6.90 | NC | NC | N | NC | 114.4 | 90.0 | 97.3 |
| 11 | 3 | 10% Mannitol | Intact | 7.08 | NC | NC | N | NC | 80.6 | 95.5 | 98.5 |
| 12 | 1 | 5% Mannitol 0.05% PS20 1 mg/mL | Intact | 7.03 | NC | NC | Y | NC | 99.0 | 88.9 | 92.1 |
| 13 | 4 | 5% Mannitol 0.05% PS20 4 mg/mL | Intact | 6.96 | NC | NC | N | NC | 83.0 | 91.4 | 97.1 |
| 14 | 7 | 5% Mannitol 0.05% PS20 7 mg/mL | Intact | 6.94 | NC | NC | N | NC | 87.0 | 91.4 | 97.8 |
| 15 | 10 | 5% Mannitol 0.05% PS20 10 mg/mL | Intact | 6.73 | NC | NC | N | NC | 84.0 | 90.4 | 98.1 |
| 16 | 6 | 5% Mannitol No Lyo | N/A | 6.91 | NC | NC | N | NC | 92.0 | 92.4 | 98.9 |
| 17 | 6 | 5% Mannitol 0.05% PS20 No Lyo | N/A | 7.08 | NC | NC | N | NC | 156.0 | 92.2 | 98.9 |
| 18 | 6 | 5% Mannitol 10% mM Met No Lyo | N/A | 7.15 | NC | NC | N | NC | 104.0 | 92.2 | 98.9 |
| 19 | 6 | 5% Mannitol 10 mM Met 0.05% PS20, No Lyo | N/A | 7.12 | NC | NC | N | NC | 100.0 | 92.4 | 98.9 |
| 20 | 6 | 5% Mannitol | Intact | 7.08 | NC | NC | N | NC | 113.5 | 90.5 | 98.9 |
| 21 | 6 | 5% Mannitol 0.05% PS20 | Intact | 7.06 | NC | NC | N | NC | 135.0 | 89.9 | 98.9 |

TABLE 33-continued

Properties of Formulations.

| # | API Conc (mg/mL) | Formulation | Cake Appearance | pH | FTIR | Intr-FL | Pellet Obs (Y/N) | SDS Page | OD 786 (%) | cIEF Area (%) | RP-HPLC Purity (%) |
|---|---|---|---|---|---|---|---|---|---|---|---|
| 22 | 6 | 5% Mannitol 10 mM Met | Intact | 7.13 | NC | NC | N | NC | 97.0 | 90.2 | 98.8 |
| 23 | 6 | 5% Mannitol 10 mM Met 0.05% PS20 | Intact | 7.04 | NC | NC | N | NC | 97.5 | 87.5 | 98.9 |
| 24 | 3 | 7% Mannitol 3% Trehalose | Intact | 6.81 | ND | ND | N | ND | 82.0 | ND | ND |
| 25 | 3 | 9% Mannitol 1% Trehalose | Intact | 6.93 | ND | ND | N | ND | 81.0 | ND | ND |
| 26 | 3 | 10% Trehalose | Phase separation | ND | ND | ND | ND | ND | ND | ND | ND |
| 27 | 3 | 10% Sucrose | Collapse and Phase Separation | ND | ND | ND | ND | ND | ND | ND | ND |
| 28 | 3 | 10% Trehalose 1% Dextran T40 | Collapse and Phase Separation | ND | ND | ND | ND | ND | ND | ND | ND |
| 29 | 3 | 8% Trehalose 1% Glycine | Collapse and Phase Separation | ND | ND | ND | ND | ND | ND | ND | ND |
| 30 | 3 | 10% Trehalose, 1% HSA | Aggregation upon HSA addition | ND | ND | ND | ND | ND | ND | ND | ND |
| 31 | 3 | 2% Mannitol 8% Trehalose | Phase Separation | ND 1 | ND | ND | ND | ND | ND | ND | ND |

Intr-FL = Intrinsic fluorescence; N/A = Not applicable; ND = Not Done; NC = No change from control.

Example 5

Preparation and Use of Compound for Targeting of Glioma Tumor Tissues

Compound 76

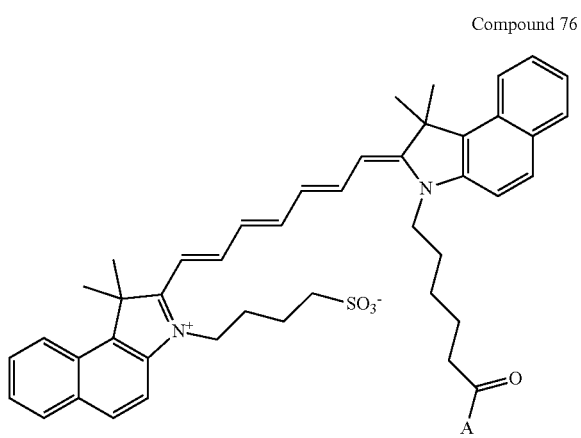

A=(PEG)-MCMPCFTTDHQMARACD DCCGGAGRGKCYGPQCLCR (K-27 is Point of Attachment)

This example shows the performance of ICG in targeting tumor tissue compared to normal tissue, often as the signal/noise ratio and the biodistribution of ICG conjugates 24 hours after injection into a subject.

N-terminal PEGylation of chlorotoxin (CTX) and Compound 76 prior to conjugation with ICG minimizes product heterogeneity resulting from potential ICG conjugation to the N-terminus in addition to the K27 site (the peptide sequence of Compound 76 having a sequence of H-Met-Cys-Met-Pro-Cys-Phe-Thr-Thr-Asp-His-Gln-Met-Ala-Arg-Ala-Cys-Asp-Asp-Cys-Cys-Gly-Gly-Ala-Gly-Arg-Gly-Lys-Cys-Tyr-Gly-Pro-Gln-Cys-Leu-Cys-Arg-OH).

PEGylation often improves solubility in aqueous solutions and the signal to noise ratio during imaging of cancerous tissue.

Three derivatives of Compound 76 were prepared, i.e., PEGaldehyde derivatives of 2 kD, 5 kD, and 40 kD. These were obtained by PEGylating Compound 76 using 2 kD, 5 kD and 40 kD PEGaldehyde derivatives, respectively. 5 kD-PEGylated modified chlorotoxin (Compound 76-5 kD) was obtained by PEGylating Compound 76 using a 5 kD polydisperse PEGaldehyde derivative.

Mice bearing U87 flank xenografts were injected with 2 nmol of each chlorotoxin based conjugate through the tail vein (IV). Twenty four hours after injection, the mice were euthanized and the tumor and leg muscle were resected or the brain, heart, liver, kidney, spleen, and blood were collected. Tumor and leg muscle resected tissue was imaged with the IVIS Spectrum equipped with a 745 nm excitation filter and an 820 nm emission filter. All tissue was frozen in OCT and stored.

Tissues were sliced using a cryostat into 12 µm thick sections and scanned using the Li-Cor Odyssey set to 21 µm resolution, high quality, intensity 7.0, channel 800 nm (excitation=785 nm). The images were quantified using the Li-Cor Odyssey software using regions of interest (ROI's) of identical size and expressed in units of Integrated Intensity (counts per mm²). Tissue was submitted to the FHCRC Experimental Histopathology core for H&E staining.

Free dye experiments were performed using Cardiogreen (ICG) (Sigma, product #I 2633). A 200 µM solution was prepared in H₂O and filter sterilized. A 40 µM dilution was prepared in 1×PBS. The ICG free dye remained in solution after this procedure and was used within 1 h after reconstitution.

Figure 8:
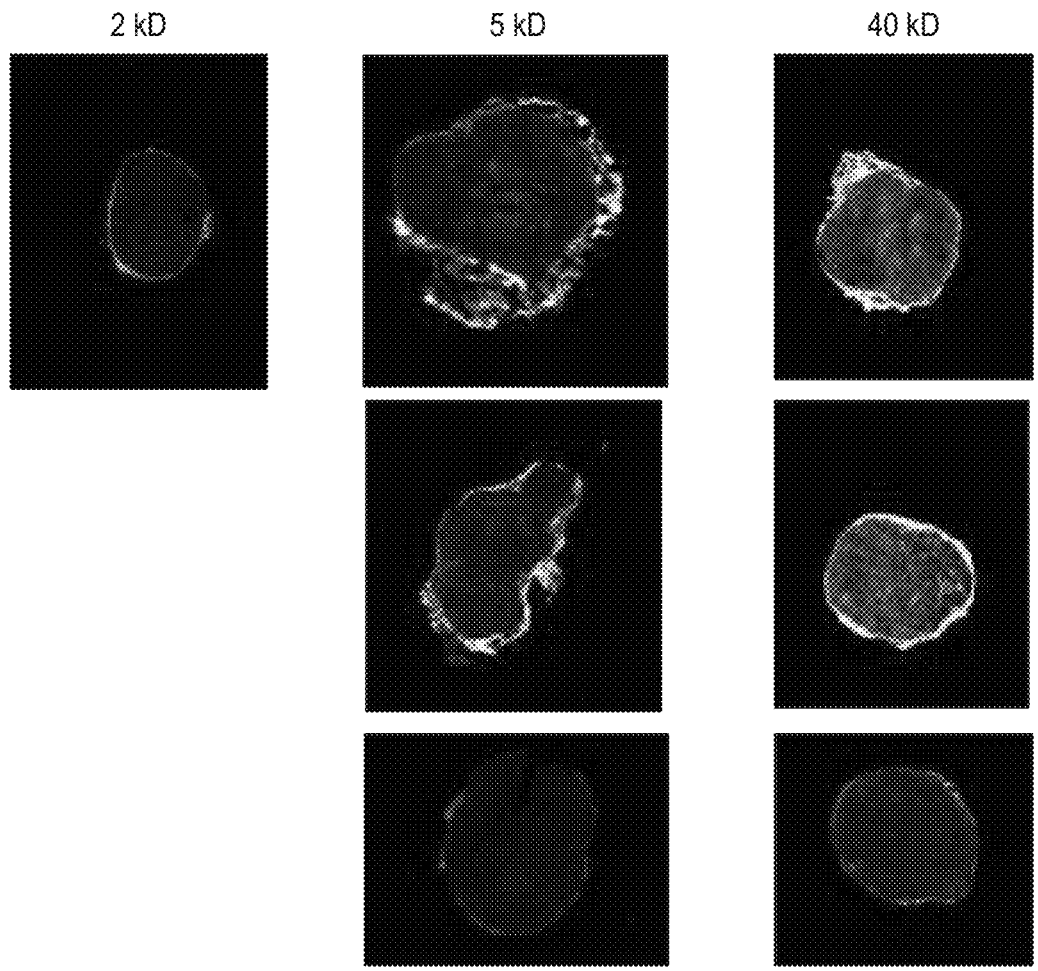
FIG. 8 shows fluorescent images of Compound 76-2 kD (left), Compound 76-5 kD (middle) and Compound 76-40 kD (right).
Figure 9A:
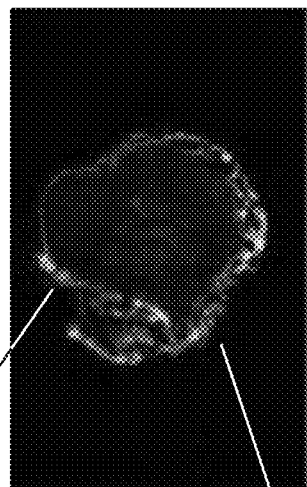
FIG. 9A shows a fluorescent image of Compound 76-5 kD.
Figure 9B:
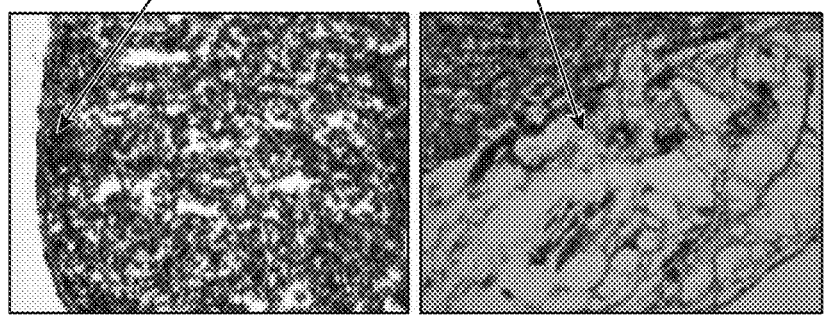
FIG. 9B shows an H&E stain of the tissue sample.

Results. The Odyssey analysis showed signal/noise for each conjugate as follows: Compound 76-2 kD, 6.6+/−3.7 (n=8); Compound 76-5 kD, 8.8+/−1.6 (n=7); Compound 76-40 kD, 10.3+/−4.4 (n=8). Representative fluorescent images from each of the conjugates are shown (FIG. 8). The capsule surrounding the tumor tissue has a high level of signal compared to the tumor cells (FIG. 9).

Compound 76-2 kD, Compound 76-5 kD, Compound 76-40 kD targeted the tumor tissue. The free dye is not detected in the tumor 24 hours after injection. PEGylated chlorotoxin conjugated to the fluorophore ICG binds to tumor tissue and is detected 24 h after injection. Tumor binding is specific to the properties of PEGylated chlorotoxin as the free dye was not detectable in tumors after 24 h.

Figure 11:
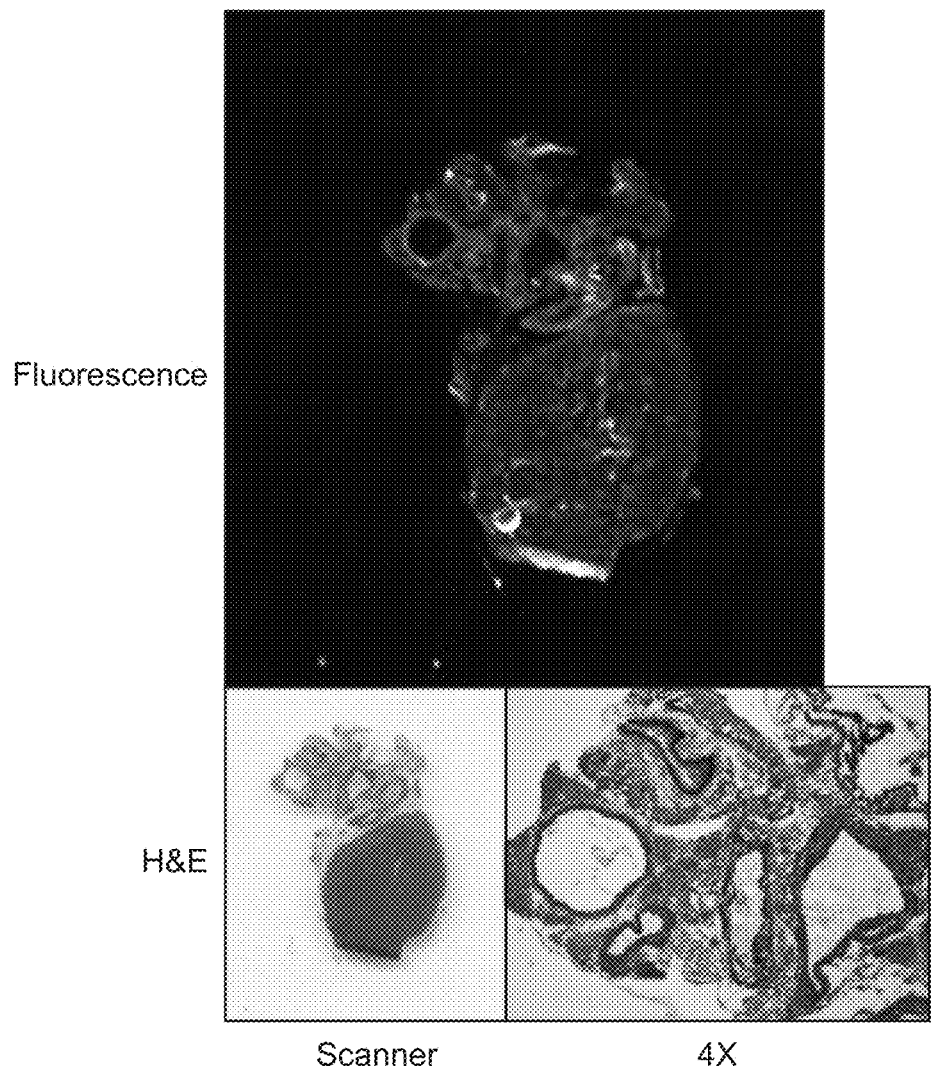
FIG. 11 shows an Odyssey fluorescent image of Compound 76-5 kD (top) and H&E stain (bottom) of heart tissue.

Biodistribution patterns 24 h after injection show that Compound 76-5 kD distributes mainly to the liver and kidney with a low signal detected in the spleen and heart. Little or no signal was detected in normal brain (FIG. 10). Additionally, significant signal was not detected in the great vessels of the heart, which has been observed with the IR800 and Cy5.5 conjugates in past experiments (FIG. 11).

ICG free dye is not detectable in liver, kidney, spleen, or brain. Free dye is detectable in the fecal matter indicating that it is cleared from the blood by the liver in into the bile. The biodistribution patterns of the conjugates therefore more closely resembles that which is seen for other CTX conjugates while the free dye biodistribution is similar to what is reported for non-conjugated ICG.

Example 6

Administration of Other Chlorotoxin Conjugate Compounds and Targeting of Glioma Tumor Tissues This example shows the use of Compounds 1-720 in targeting tumor tissue compared to normal tissue, as the signal/noise ratio and the biodistribution of chlorotoxin conjugate compounds 1 to 720 at 24 hours after injection into a subject.

Materials and methods are used as described in Example 5 but with Compounds 1-720.

Results. Compounds 1-720 preferentially target and label tumor tissue and capsules surrounding tumors. Biodistribution patterns 24 h after injection show that Compounds 1-720 distribute mainly to the liver and kidney with a low signal detected in the spleen and heart. Little or no signal is detected in normal brain or in great vessels of the heart.

Example 7

Dose Intervals and Imaging Intervals Using Compound 16 for Detection of Glioma Tumors in Models This example shows the optimal imaging time and dose of Compound 16 in mice and further shows that Compound 16 targets U87 human glioma cells implanted into the brains of mice. Compound 16 signal in tumor compared to normal brain (signal-to-noise ratio, SNR) was compared to the SNR calculated in subcutaneous U87 flank xenografts using both whole tissue imaging and sliced tissue analysis.

Materials. Compound 16 in 10 mM Tris and 5% Mannitol at concentrations of 0.03 mg/ml or 6 µM (0.6 nmole/100 µl); 0.1 mg/ml or 20 µM (2 nmole/100 µl); 0.3 mg/ml or 60 µM (6 nmole/100 µl); 0.5 mg/ml or 100 µM (10 nmole/100 µl); and 1 mg/ml or 200 µM (20 nmole/100 µl); 10 nmole/100 µl (0.5 mg/ml).

Methods. Nu/Nu female mice bearing U87 (human glioma cell line cultured using standard culture conditions in DMEM (Invitrogen), 10% Fetal Bovine Serum (Qualified #26140, Invitrogen), Pen/Strep (Invitrogen) xenografts in the flank were injected through the tail vein with 0.6, 2, 6, 10, or 20 nmol of Compound 16 in a total volume of 100 µl. Mice were euthanized 1, 2, or 3 days after injection. Tumor, muscle, and skin were collected for all mice. Brain, heart, liver, and kidney were dissected for a subset of mice. The tissues were imaged using the IVIS Spectrum (Perkin Elmer) and quantified using Living Image software (Perkin Elmer). The tumor tissue was frozen on dry ice in OCT, sliced into 12 µm sections, and scanned on the Odyssey CLx near-infrared imaging system (Li-Cor Biosciences) using the 800 nm channel (785 nm excitation). The tissue was scanned using the "auto" intensity setting and 21 µm resolution. Images were analyzed using the Image Studio software (Li-Cor) by measuring the fluorescent signal within a region of interest (ROI) drawn in each tissue image.

Orthotopic xenograft implants were generated using five week old female Nu/Nu mice (Harlan Laboratories) anesthetized with isoflurane. The scalp was swabbed with providone-iodine and alcohol. Using a scalpel, an incision was made in the scalp down the midline in the area of the cerebral cortex. A burr hole was drilled through the skull using a micro-drill fitted with a 0.9 mm bit. The burr hole was placed into the right cerebral hemisphere approximately 1 mm lateral (right) of the sagittal suture, 2 mm anterior to the lambdoid suture, and 2 mm deep. Using a p20 pipet and tip, 100,000 U87 cells suspended in serum-free DMEM (Invitrogen) was injected into the brain. The burr hole was covered with a Gelfoam Sponge (Pfizer) fragment and the incision closed with Vetbond tissue adhesive (3M). The mouse received bupivacaine at the injection site for pain relief. Mice developed tumors approximately 4 weeks after implantation.

Three mice with orthotopic U87 brain tumors and three mice with U87 flank tumors received tail vein injections of 100 µl of a 10 nmol/100 µl dose of Compound 16. One day after injection the mice were euthanized using $CO_2$ inhalation. The brains bearing orthotopic xenografts, flank tumors, and normal brain were excised and imaged on the Ivis Spectrum (Perkin Elmer) using the 745 nm excitation and 820 nm emission filters. The whole tissues were then imaged on the Odyssey CLx near-infrared imaging system (Li-Cor Biosciences) using the 800 nm channel (785 nm excitation). The tumor tissue was frozen on dry ice in Optimal Cutting Tissue medium (OCT) (Tissue Tek), sliced into 12 µm sections, placed on charged slides (Fisherbrand) and scanned on the Odyssey. The tissue was scanned using the "auto" intensity setting and 21 µm resolution. Images were analyzed using the Image Studio software (Li-Cor) by measuring the fluorescent signal within a region of interest (ROI) drawn in each tissue image. Slides were stained with Hematoxylin and Eosin (H&E) using standard histological protocols.

Figure 12A:
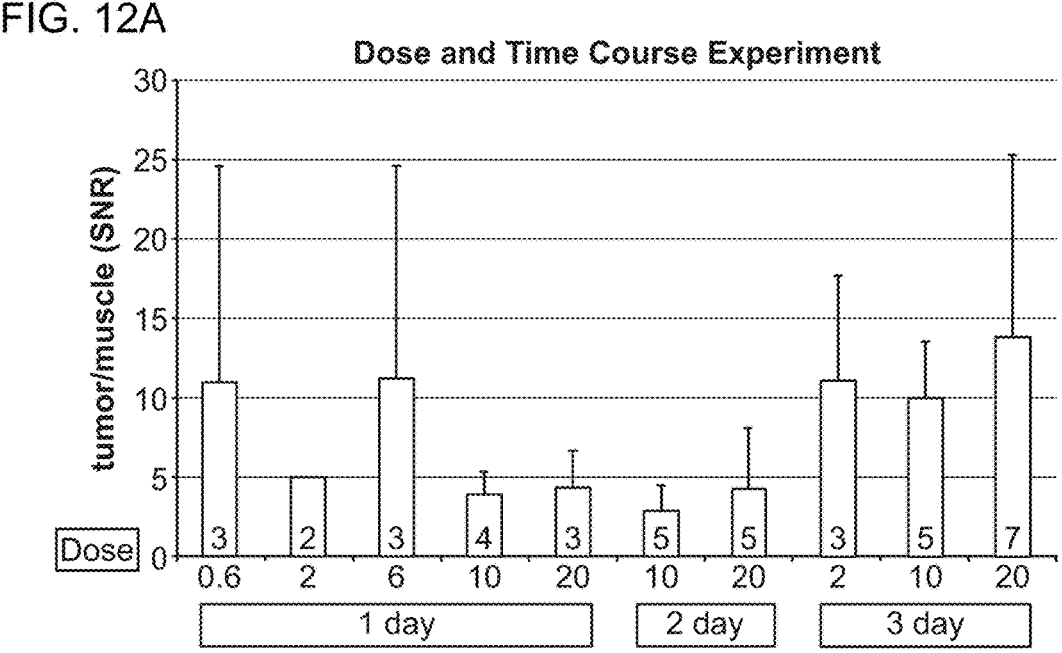
FIG. 12A SNR (tumor/muscle) for different doses of chlorotoxin conjugate (n=2-7; sample size is shown inside each column; error=standard deviation).
Figure 12B:
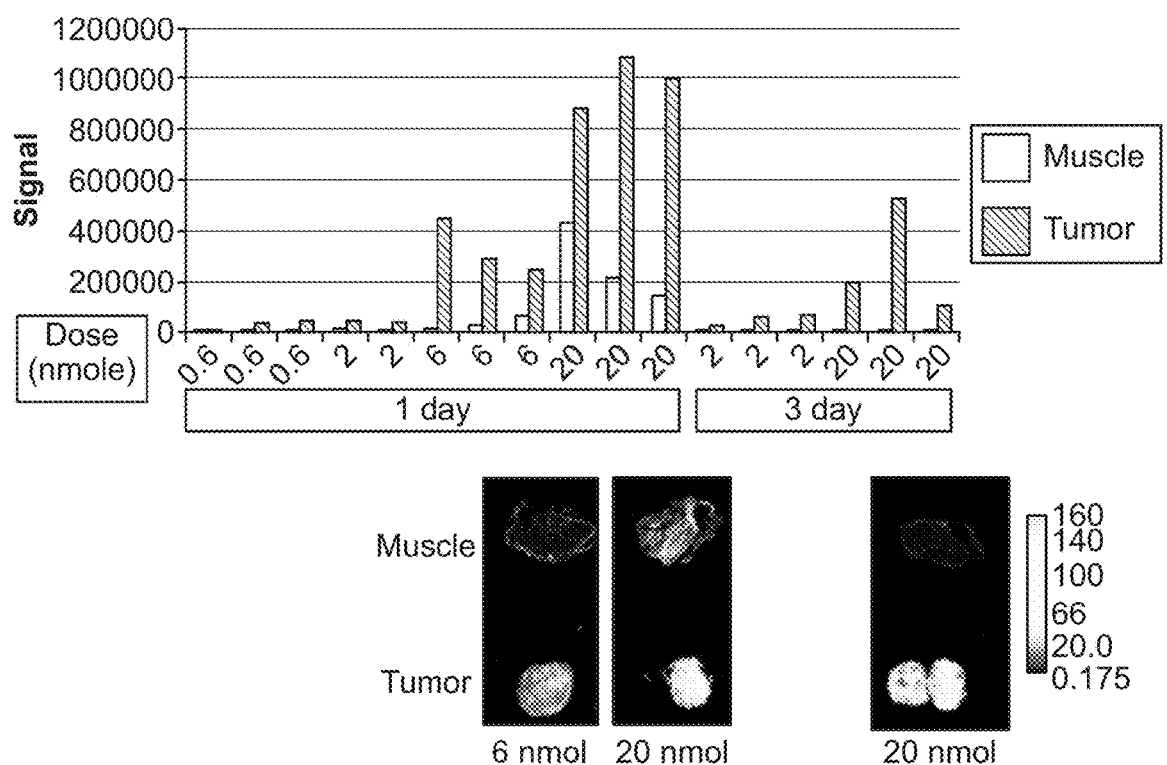
FIG. 12B shows signal from a subset of tumor and muscle samples. Representative muscle and tumor images for the 6 nmol and 20 nmol dose groups 1 and 3 days post injection are shown below the graph.

Results. Signal in tumor compared to muscle (SNR) was analyzed 1-3 days after Compound 16 injections. In the flank model, SNR at the one day time point was greatest with a 6 nmol dose while SNR was highest at the three day time point with a 20 nmol dose (FIG. 12). SNR was driven by the lower signal in normal muscle which was lower in the 6 nmol cohort than the 20 nmol group one day after injection (FIG. 12). The signal in muscle decreased considerably three days after injection. Signal in the tumor decreased after three days while the ratio of signal in tumor to muscle improved.

Normal brain, skin, heart, liver, and kidney were evaluated in a subset of animals. The tissues were excised one or three days after injection and imaged ex vivo using the IVIS Spectrum. Signal increased with increased dose for all tissues. Signal was highest in the skin, liver, and kidney.

Figure 14:
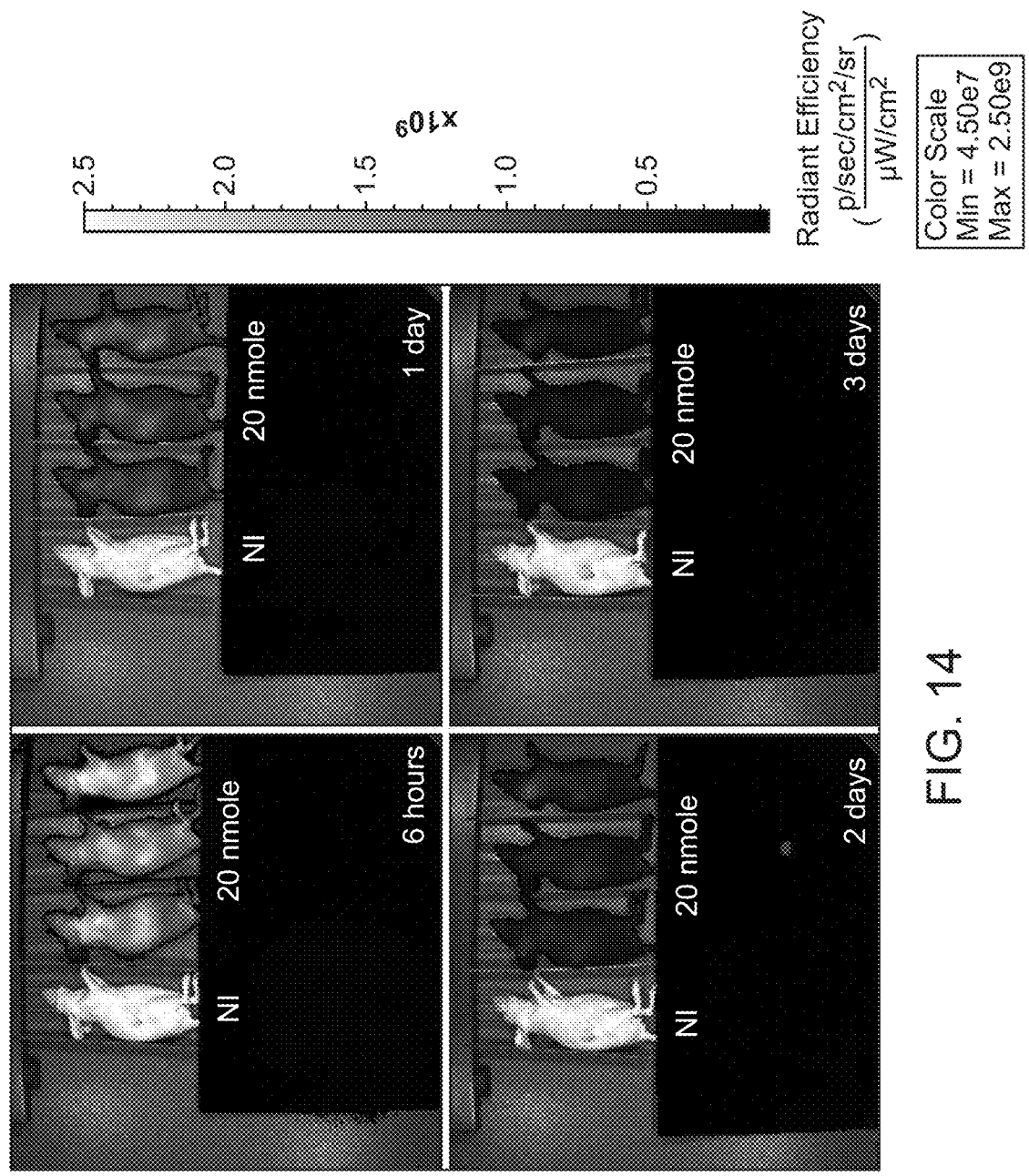
FIG. 14 shows whole body live animal imaging of chlorotoxin conjugate from six hours to three days after injection.

Signal declined in all tissues by the three day time point (FIG. 13A-FIG. 13C). Signal in the kidney declined 5.6 fold in the 20 nmol group while signal in the skin declined by 3.7 fold. Whole body live animal imaging shows rapid distribution of Compound 16 six hours after injection then a decline signal over the next three days (FIG. 14).

In order to standardize tissue thickness, the tissue was sliced in 12 μm sections, scanned, and analyzed. SNR in the orthotopic samples was 12.7-200 while the SNR for the flank xenograft tissue was 246-344. The higher SNR ratios between whole tissue and sliced tissue analysis is most likely due to the very low levels of signal detected in normal brain tissue which were often below the level of detection in 12 μm sections.

Signal in tumor tissue compared to normal muscle was dose and time dependent. The optimal dose for a one day imaging time point was determined to be 6 nmol while the optimal dose for a three day time point was 20 nmol. Signal in normal tissues distributes rapidly after injection with the highest accumulation of Compound 16 in the kidney, liver, and skin one day after injection. Compound 16 cleared out of normal tissues with residual amounts remaining in the kidney, liver, and skin after three days.

Optimal imaging time after Compound 16 injection was assessed for doses between 0.6- and 20 nmol. Mice with U87 flank xenografts were imaged 1, 2 or 3 days after injection. For one day imaging, signal in tumor compared to muscle (signal to noise ratio, SNR) was greatest at 6 nmol doses. For three day imaging, SNR was greatest at 20 nmol doses.

Tumor targeting and imaging efficacy of Compound 16 was assessed in the U87 orthotopic brain xenograft mouse model of glioma. Mice with U87 human glioma cells implanted in either the brain or the flank were injected with 10 nmole of Compound 16. Brain and tumor tissue was excised and imaged 1 day after injection. Signal in tumor compared to normal brain was assessed on both whole tissue images and frozen tissue sliced in 12 μm sections. Signal in tumor compared to normal brain (SNR) was 11.6-60 for the orthotopic xenograft samples and 131-138 for the flank xenograft samples (FIG. 13A-FIG. 13C). Because most of the tumor tissue adhered to the skull, orthotopic sample #1 was not included in the quantitative analysis. Residual tumor cells were detected in the brain (FIG. 13A-FIG. 13C).

Figure 15B:
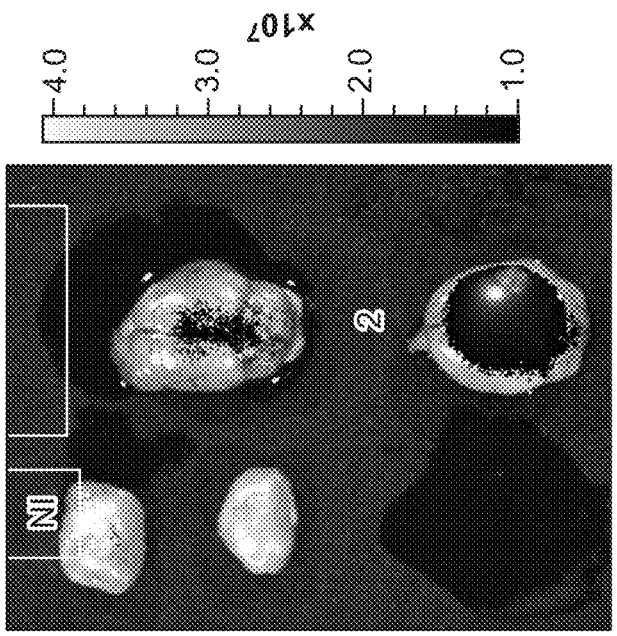
FIG. 15B shows ex vivo imaging of the brain from orthotopic mouse #2.
Figure 15A:
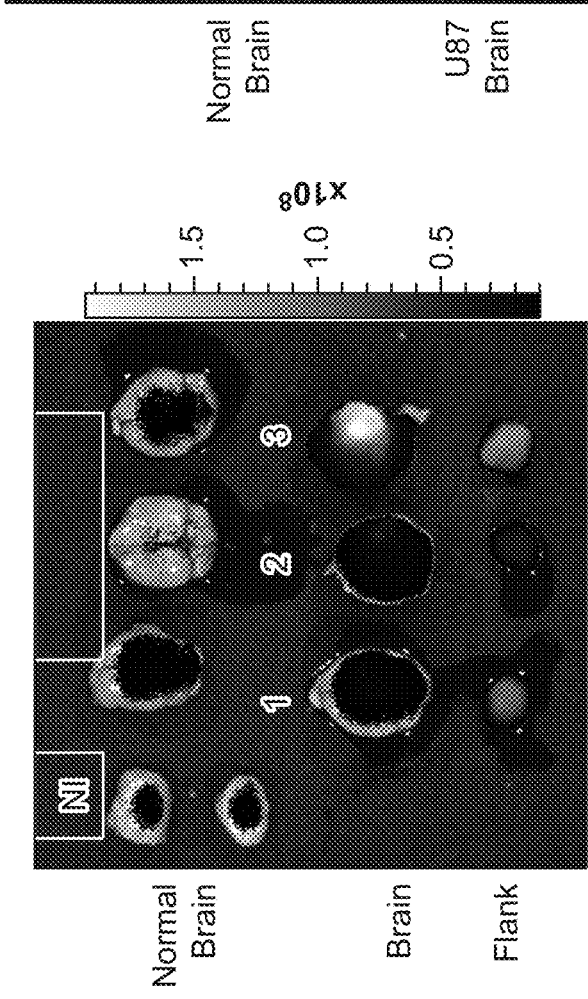
FIG. 15A shows ex vivo imaging of chlorotoxin conjugate 1 day after injection using the IVIS Spectrum.
Figure 15C:
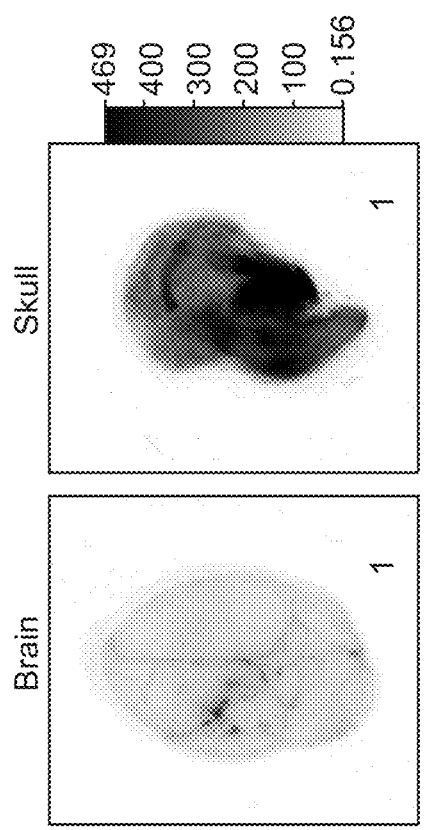
FIG. 15C shows ex vivo Odyssey imaging of the brain and skull from orthotopic mouse #1.

Compound 16 was detected in tumors from two out of three U87 orthotopic brain tumors using the IVIS Spectrum (FIG. 15). The brain tumor from orthotopic #1 did not have a signal on the Ivis Spectrum. The absence of signal was due to the tumor tissue adhering to the underside of the skull which was subsequently pulled out of the brain during necropsy. Compound 16 signal was detected in the skull during whole tissue imaging on the Odyssey (FIG. 15).

Example 8

Dose Intervals and Imaging Intervals Using Other Chlorotoxin Conjugate Compounds for Detection of Glioma Tumors in Models This example evaluates the optimal imaging time and dose of Compounds 1-720 in mice and further shows that Compounds 1-720 target U87 human glioma cells implanted into the brains of mice. Compounds 1-720 signal in tumor compared to normal brain (SNR) is compared to the SNR calculated in subcutaneous U87 flank xenografts using both whole tissue imaging and sliced tissue analysis.

Materials and methods are as described in Example 7.

Results. Signal in tumor compared to muscle (SNR) is analyzed 1-3 days after Compounds 1-720 injections. SNR at the one day time point is greatest with a 6 nmol dose while SNR is highest at the three day time point with a 20 nmol dose. SNR is driven by the lower signal in normal muscle which is lower in the 6 nmol cohort than the 20 nmol group one day after injection. The signal in muscle decreased considerably three days after injection. Signal in the tumor decreases after three days while the ratio of signal in tumor to muscle improves.

Normal brain, skin, heart, liver, and kidney are evaluated. Signal increases with increased dose for all tissues. Signal is highest in the skin, liver, and kidney. Histopathology analysis of mice, rats, and non-human primates treated with doses as high as 100× standard imaging dose of Compounds 1-720 finds no test article related toxicity.

Signal declines in all tissues by the three day time point. Whole body live animal imaging shows rapid distribution of Compounds 1-720 six hours after injection then a decline signal over the next three days.

Signal in tumor tissue compared to normal muscle was dose and time dependent. The optimal dose for a one day imaging time point was determined to be 6 nmol while the optimal dose for a three day time point was 20 nmol. Signal in normal tissues distributes rapidly after injection with the highest accumulation of Compounds 1-720 in the kidney, liver, and skin one day after injection. Compounds 1-720 clear out of normal tissues with residual amounts remaining in the kidney, liver, and skin after three days.

Optimal imaging time after injection of Compounds 1-720 is assessed for doses between 0.6- and 20 nmol. Mice with U87 flank xenografts are imaged 1, 2 or 3 days after injection. For one day imaging, signal in tumor compared to muscle (signal to noise ratio, SNR) is greatest at a lower dose than the optimal dose for high SNR when imaging after three days.

Tumor targeting and imaging efficacy of Compounds 1-720 is assessed in the U87 orthotopic brain xenograft mouse model of glioma. Mice with U87 human glioma cells implanted in either the brain or the flank are injected with 10 nmole of Compounds 1-720. Brain and tumor tissue is excised and imaged 1 day after injection. Signal in tumor compared to normal brain is assessed on both whole tissue images and frozen tissue sliced in 12 μm sections. Signal in orthotropic brain tumors is higher than normal brain tissue using whole tissue imaging and sliced tissue analysis. Signal in flank tumors is higher than normal brain tissue using whole tissue imaging and sliced tissue analysis.

Example 9

Ex Vivo Image Analysis and Determination of Optimal Dose for Imaging in Dogs

This example describes the determination of optimal BLZ-100 imaging dose in dogs with naturally occurring tumors. This analysis was conducted using tissues from dogs enrolled in the study described in Example 19. The optimal clinical imaging dose is a function of the overall fluorescence intensity of the tumor, which impacts ease of detection, and the ratio of signal in the tumor tissue compared with the normal tissue in which it resides. Comparison of tumor intensity and signal to background were performed using ex vivo imaging on gross tumors and sections.

BLZ-100 was given intravenously at fixed doses of 0.1-1.5 mg in a dose escalation scheme, followed by expansion at the apparent optimal dose. To normalize for variation in body size, doses were computed in mg/m² for all dogs. Doses (mg/m²) were 0.25-0.8 (7 dogs), 0.8-1.2 (16) and 1.2-1.6 (5).

The Odyssey near-infrared scanner (Li-Cor) is a flat-bed scanner that is optimized for detection of 800 nm fluorescence. It has 21 micron resolution and gives quantitative data for up to 9 orders of magnitude of intensity. This instrument was able to measure fluorescence in even the very early samples from patients treated with the lowest doses. Data from the gross tumor Odyssey scans was used to compare overall fluorescence across all doses administered. The analysis shows that at the low doses, tumor intensity is correlated with dose level. At doses up to 0.8 mg/m², signal in gross tumor samples increased as a function of dose. At doses above 0.8 mg/m², no further gain in fluorescence was apparent under these conditions. Therefore this is the lower limit of the optimal dose range for imaging canine tumors under at least these conditions.

Tumor type was the most important variable in imaging intensity at doses greater than 0.8 mg/m². A total of 21 dogs were treated with doses above this threshold. In order to compare gross fluorescence intensity across samples, a region of interest analysis was conducted using the Odyssey scans of the gross tumors. A subset of the soft tissue sarcomas had highest overall uptake, followed by the carcinomas (adenocarcinoma and squamous cell carcinoma). Oral fibrosarcomas had the lowest overall uptake, but it was unclear whether this was due to the histologic subtype or to anatomic location. There were no associations between signal and other study variables, such as breed and body mass. The data show that soft tissue sarcomas, as a class, have the highest fluorescence, with a median intensity almost threefold that of the carcinomas, and a maximum more than 7 fold higher.

In dogs treated with 0.8 mg/m² or higher (21 dogs in total), ratios of fluorescence in tumor to normal surrounding tissue ranged from <1 (no specific signal, 3 dogs) to >200, with good differentiation in several tumor types including meningioma, carcinomas (lung, thyroid, and mammary), and sarcomas. Highest signals and gross tumor to background ratios were seen in a subset of soft tissue sarcomas, suggesting preferential uptake of the conjugate in these tumor types.

The soft-tissue sarcomas showed the most intense fluorescence on gross imaging, so these tumors were selected to perform a histopathologic analysis of tumor to background ratio for determination of the upper limit of the optimal dose range. It is presumed that when tumor uptake is maximal, further dose administration will result in higher background staining and reduction in tumor to background ratio (TBR). The analysis of soft-tissue sarcomas showed that this was indeed the case.

Four soft tissue sarcoma cases were available for this analysis (Patients 11, 12, 13, and 19). Tissues were sectioned on a cryostat, and 30 micron sections were imaged on the Odyssey scanner. These sections or serial sections were stained with H&E and read by an expert histopathologist who was blinded to the fluorescence data. A grid was overlaid on the fluorescence image, and total fluorescence in each grid square was measured using Image Studio (Li-Cor) software provided with the Odyssey scanner. Overlay of the fluorescence image with the scored H&E image enabled calling of tumor vs. non-tumor for each grid square. The average of the fluorescence intensity across all tumor and non-tumor grid squares in a section was used to compute TBR for each patient. The TBR declined with increasing dose across these four tumor samples, indicating that higher doses may contribute to increased background staining and loss of specificity. The time between dose and imaging may also influence the TBR.

Dog 13 (TBR 207) had surgery 48 hours after dose administration, and dogs 11 (TBR 0.44), 12 (TBR 16), and 19 (TBR 4) had surgery 24 hours after dose administration. Excluding dog 13, comparison of the TBR for the 24 hour cases shows the same trend, supporting the overall conclusion.

Taken together, these data suggest that the optimal imaging dose for tumor imaging in dogs is in the 0.8-1.2 mg/m² range.

Example 10

Ex Vivo Image Analysis and Determination of Optimal Dose for Imaging Using Compound 16

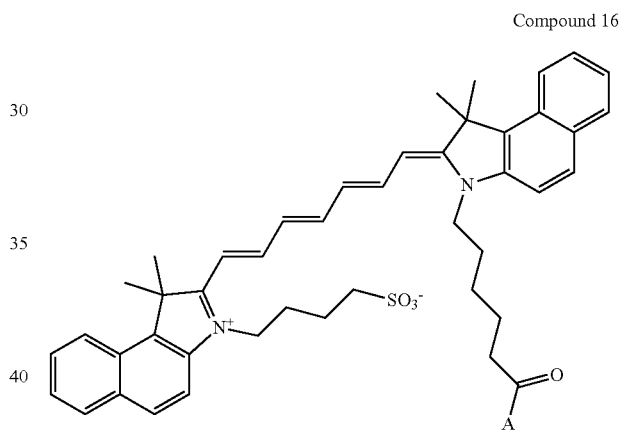

Compound 16

A=MCMPCFTTDHQMARRCDDC CGGRGRGKCYGPQCLCR (K-27 is Point of Attachment)

This example describes the determination of optimal chlorotoxin conjugate Compound 16 imaging dose in dogs with naturally occurring tumors.

Figure 16:
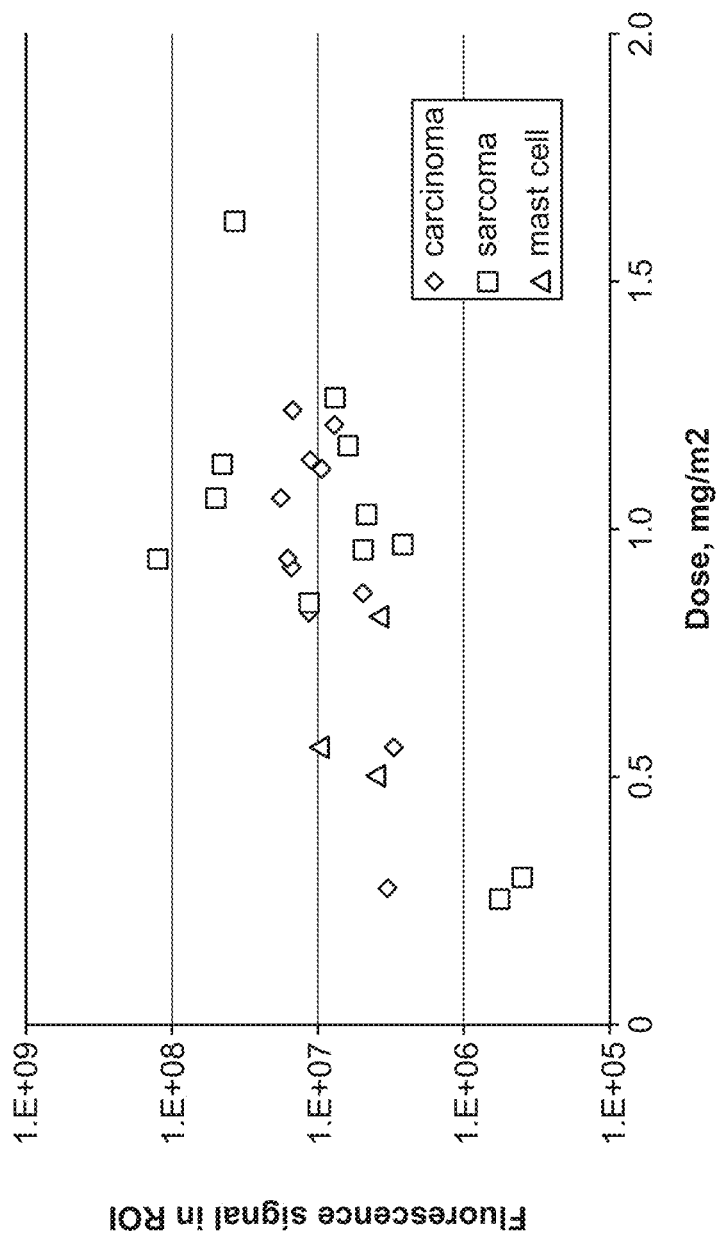
FIG. 16 shows fluorescence intensity in gross tumors, grouped by tumor type. Regions of interest (ROI) were drawn on Odyssey scans of gross tumors. ROIs were the same size across the data set.
Figure 17:
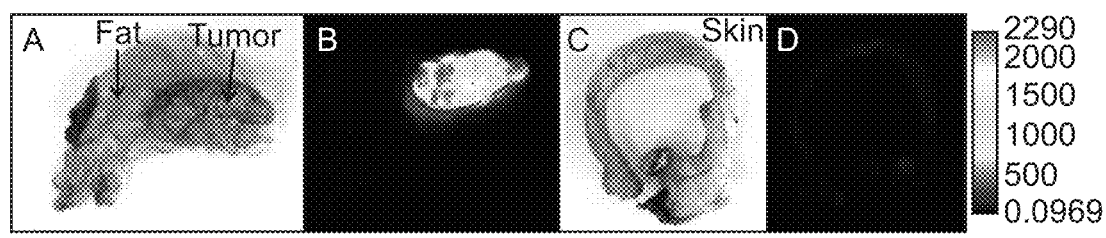
FIG. 17 shows ex vivo imaging of a canine soft tissue sarcoma. Patient 13 was a 7-year-old female Standard Poodle who presented with a subcutaneous hemangiopericytoma, a type of soft tissue sarcoma. She was treated with BLZ-100 at 0.94 mg/m$^2$, and surgery was performed 48 hours later. White light (A, C) and Odyssey near-infrared (B, D) images are shown of gross tumor and adjacent normal fat (A, B) and uninvolved skin (C, D). Gross ratios of tumor to fat were 257:1 to 127:1, and gross ratios of tumor to skin were 89:1 to 33:1.

Chlorotoxin conjugate Compound 16 was given intravenously at fixed doses of 0.1-1.5 mg in a dose escalation scheme, followed by expansion at the apparent optimal dose. The total fluorescence within each region of interest (ROI) was plotted as a function of dose (FIG. 16). A subset of the soft tissue sarcomas had highest overall uptake, followed by the carcinomas (adenocarcinoma and squamous cell carcinoma). Oral fibrosarcomas had the lowest overall uptake, but it was unclear whether this was due to the histologic subtype or to anatomic location. Highest signals and gross tumor to background ratios were seen in a subset of soft tissue sarcomas (FIG. 17), suggesting preferential uptake of the conjugate in these tumor types.

Figure 18:
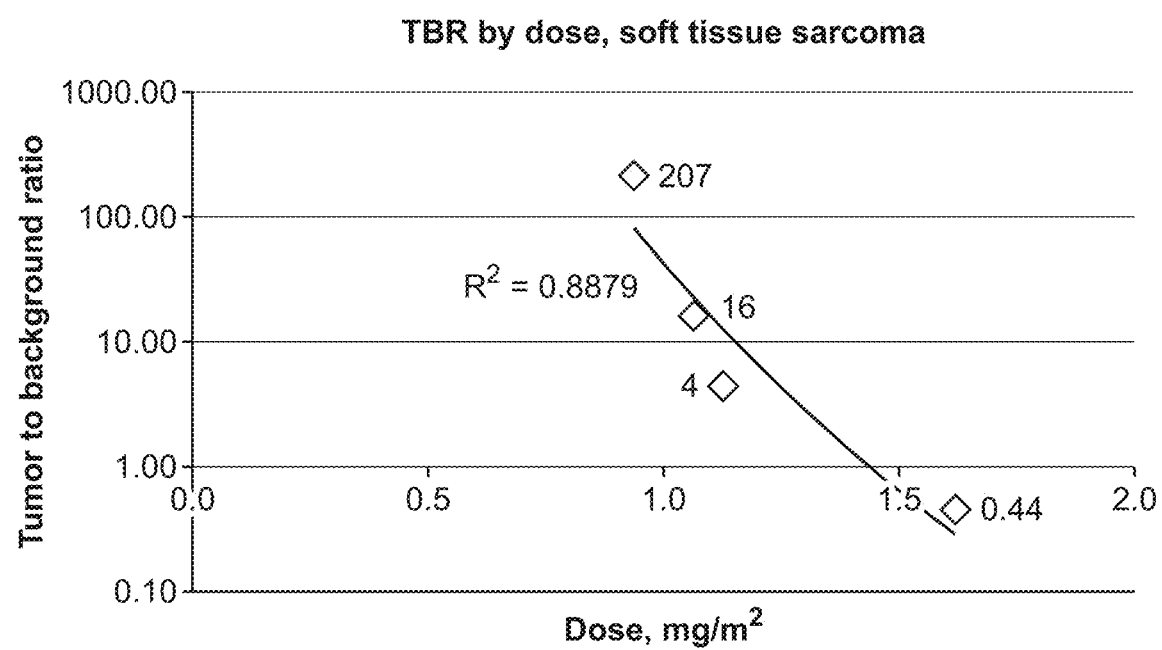
FIG. 18 shows a determination of the chlorotoxin conjugate dose at which tumor to background ratio is maximal. Sections of tumor and non-tumor tissue were scored by a histopathologist who was blinded to the fluorescence data. Total fluorescence in 2×2 mm grid squares was measured, and each square was designated tumor or non-tumor by overlaying the fluorescence image with the H&E image scored by the histopathologist. The average of tumor and non-tumor squares was used to compute the tumor to background ratio (TBR), shown at right of each data point.

The soft-tissue sarcomas showed the most intense fluorescence on gross imaging, so these tumors were selected to perform a histopathologic analysis of tumor to background ratio for determination of the upper limit of the optimal dose range. The average of the fluorescence intensity across all tumor and non-tumor grid squares in a section was used to compute TBR for each patient. The results are shown in FIG. 18. The TBR declined with increasing dose, indicating that higher doses may contribute to increased background staining and loss of specificity.

Taken together, these data suggest that the optimal imaging dose for tumor imaging in dogs with Compound 16 is in the 0.8-1.1 mg/m$^2$ range.

Example 11

Ex Vivo Image Analysis and Determination of Optimal Dose for Imaging Using Other Chlorotoxin Conjugate Compounds This example describes the determination of optimal imaging dose of Compounds 1-720 in dogs with naturally occurring tumors.

Compounds 1-720 are given intravenously at fixed doses, followed by expansion at the apparent optimal dose.

Materials and methods are as in Example 9, but with Compounds 1-720.

The analysis shows that at the low doses, tumor intensity is correlated with dose level. Tumor type is the most important variable in imaging intensity at higher doses. There are no associations between signal and other study variables, such as breed and body mass.

Soft-tissue sarcomas are selected to perform a histopathologic analysis of tumor to background ratio for determination of the upper limit of the optimal dose range. When tumor uptake is maximal, further dose administration results in higher background staining and reduction in tumor to background ratio (TBR).

TBR declines with increasing dose for tumor samples, indicating that higher doses may contribute to increased background staining and loss of specificity. The time between dose and imaging may also influence the TBR.

Taken together, these data establish an optimal imaging dose for tumor imaging in dogs with Compounds 1-720.

Example 12

Quantitation of Fluorescence by Type of Tumor

This example describes a method for quantitating the fluorescence for various tumor types labeled with BLZ-100. Multiple canine tumor types were explored in this study in order to determine whether specific tumor types are more amenable to imaging with a chlorotoxin conjugate than others, and to gain broad experience with tumors arising in various anatomic locations and tissue types.

As an initial study of gross fluorescence intensity, the highest pixel intensity for each gross tumor sample was plotted as described above. All tumors except the meningioma (see below) were available for this analysis. Grouping the tumors by anatomic location showed that for most tumors, overall signal was related more to dose than to anatomic location. The exception was for tumors arising in bone; these were consistently low at each dose range, suggesting that there may be some tissue-specific influence on BLZ-100 uptake.

Grouping the tumors by tumor type shows that the soft-tissue sarcomas as a group show the highest fluorescence and the most variability in gross imaging. The soft-tissue sarcomas include a wide variety of histologic types and grades, so the variability seen in this class may be due to variation in histology and/or grade. They also can have high intratumor variability (see below), so some of the variation in the Odyssey data could be due to the sections of tumor that were sampled. Two patients with fibrosarcoma in the group treated with effective imaging doses had tumors arising in the jaw. Since tumors arising in the jaw generally had poor uptake, it is unclear whether the anatomic site played a role in the limited uptake and specificity in these tumors.

The intensity values for soft-tissue sarcomas (all subtypes) and the carcinomas (adenocarcinomas and squamous cell carcinomas) were compared for all cases treated with doses at or above 0.8 mg/m$^2$. This analysis revealed a high level of variability among soft-tissue sarcomas, and weaker but more consistent intensities among the carcinomas.

In dogs treated with 0.8 mg/m$^2$ or higher (21 dogs in total), ratios of fluorescence in tumor to normal surrounding tissue ranged from <1 (no specific signal) to >200.

Taken together, the gross tissue imaging data suggest that soft-tissue sarcomas are a tumor type with very high potential for the clinical utility of a chlorotoxin.

Example 13

Quantitation of Fluorescence by Type of Tumor Using Chlorotoxin Conjugate Compound 16

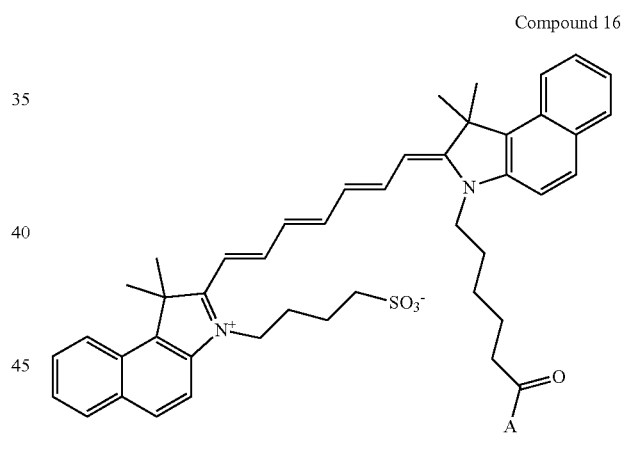

Compound 16

A=MCMPCFTTDHQMARRCDDCCG GRGRGKCYGPQCLCR (K-27 is Point of Attachment)

Figure 19:
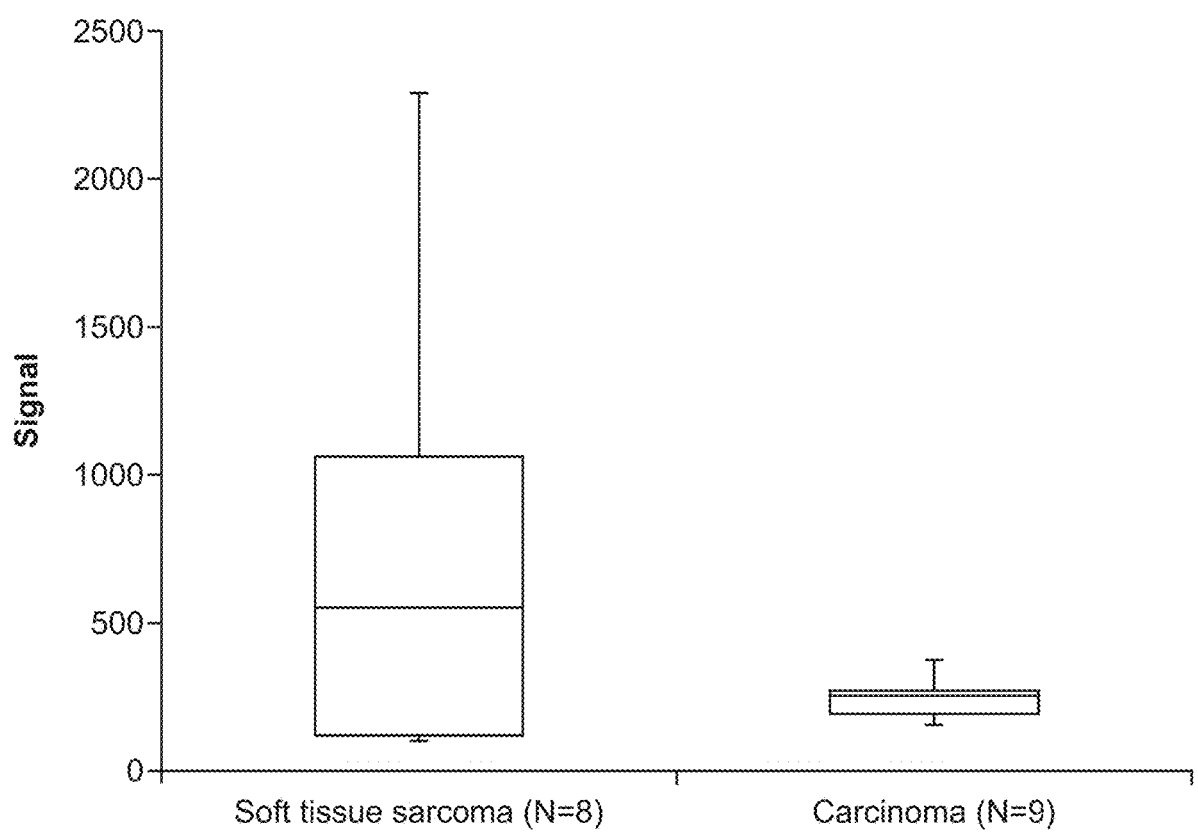
FIG. 19 shows a box & whiskers plot of gross tumor intensity for soft-tissue sarcomas (all subtypes) and carcinomas (including adenocarcinoma and squamous cell carcinoma). Tissues were labeled with BLZ-100.

This example describes a method for quantitating the fluorescence for various tumor types labeled with chlorotoxin conjugate Compound 16. Multiple canine tumor types were explored. The intensity values for soft-tissue sarcomas (all subtypes) and the carcinomas (adenocarcinomas and squamous cell carcinomas) were compared for all cases treated with doses at or above 0.8 mg/m$^2$. This analysis shows the variability among soft-tissue sarcomas, and the lower but relatively consistent intensities among the carcinomas (FIG. 19).

Ratios of fluorescence in tumor to normal surrounding tissue ranged from <1 (no specific signal) to >200 as shown in Table 34.

TABLE 34

Summary of gross imaging data for dogs treated with 0.8 mg/m² or higher (N = 21).

| Tumor type | Summary of canine tumors |
|---|---|
| Brain tumors | Meningioma (1): TBR 2.5 |
| Head & Neck cancer | Oral squamous cell carcinoma (1): TBR 2-3 |
| Lung cancer | Adenocarcinoma (1): TBR 3 |
| Breast cancer | Mammary carcinoma (3): TBR 2.5-9 Mammary sarcoma (1): TBR could not be calculated due to lack of adequate normal tissue. Signal in gross tumor was very high. |
| Skin cancer | Cutaneous squamous cell carcinoma (2): TBR 2.5-5 |
| Soft-tissue sarcoma | Haemangiopericytoma (1): TBR 33-89 vs. skin, 73-257 vs. fat Soft-tissue sarcoma, subtype not specified (3): ,TBR 5-17 Spindle cell (1): TBR 2 Fibrosarcoma, jaw (2): TBR 0.5-3 (low uptake in tumors, and high background in oral mucosa) Hemangiosarcoma, vertebral body (1): TBR <1 Chondrosarcoma (1): non-specific; patient had radiation therapy prior to treatment. Tumor was necrotic and nasal mucosa had high background. |
| Other | Thyroid carcinoma (2): TBR 2-3 Mastocytoma (1): TBR 1.5 |

TBR: tumor to background ratio

Example 14

Quantitation of Fluorescence by Type of Tumor Using Other Chlorotoxin Conjugate Compounds This example describes a method for quantitating the fluorescence for various tumor types labeled with Compounds 1-720. Multiple tumor types are explored in this study in order to determine whether specific tumor types are more amenable to imaging with a chlorotoxin conjugate than others, and to gain broad experience with tumors arising in various anatomic locations and tissue types.

Materials and methods used are as in Example 12 but with Compounds 1-720. Grouping the tumors by anatomic location shows that for most tumors, overall signal is related more to dose than to anatomic location.

Grouping the tumors by tumor type shows that the soft-tissue sarcomas as a group show the highest fluorescence and the most variability in gross imaging. The soft-tissue sarcomas include a wide variety of histologic types and grades, so the variability seen in this class may be due to variation in histology and/or grade. They also can have high intratumor variability, so some of the variation in the Odyssey data could be due to the sections of tumor that were sampled.

The intensity values for soft-tissue sarcomas (all sub-types) and the carcinomas (adenocarcinomas and squamous cell carcinomas) are compared for all cases treated with doses at or above 0.8 mg/m². This analysis shows the variability among soft-tissue sarcomas, and the lower but relatively consistent intensities among the carcinomas.

Taken together, the gross tissue imaging data suggest that soft-tissue sarcomas are a tumor type with very high potential for the clinical utility of Compounds 1-720.

Example 15

Tolerability of Compound 16 in Normal Mice

This example shows experimental analysis of tolerability of Compound 16 in normal CD-1 mice.

Methods. Compound 16 was formulated in 10 mM Histidine, 5% Dextrose at concentrations of 5, 0.5, 0.05 mg/ml. Chlorotoxin free peptide (KNT-01) was manufactured by Alamone Laboratory and formulated in 10 mM Histidine, 5% Dextrose at a concentration of 1 mM (200 nmole/200 μl). Compound 76 free peptide (KNT-02) was manufactured by American Peptide Company and formulated in 10 mM Histidine, 5% Dextrose at a concentration of 1 mM (200 nmole/200 μl) (the peptide component of Compound 76 having a sequence of H-Met-Cys-Met-Pro-Cys-Phe-Thr-Thr-Asp-His-Gln-Met-Ala-Arg-Ala-Cys-Asp-Asp-Cys-Cys-Gly-Gly-Ala-Gly-Arg-Gly-Lys-Cys-Tyr-Gly-Pro-Gln-Cys-Leu-Cys-Arg-OH). Compound 16 free peptide was manufactured by Bachem and formulated in 10 mM Histidine, 5% Dextrose at concentrations of 1 mM, 0.1 mM and 0.01 mM (the peptide component of Compound 16 having a sequence of H-Met-Cys-Met-Pro-Cys-Phe-Thr-Thr-Asp-His-Gln-Met-Ala-Arg-Arg-Cys-Asp-Asp-Cys-Cys-Gly-Gly-Arg-Gly-Arg-Gly-Lys-Cys-Tyr- Gly-Pro-Gln-Cys-Leu-Cys-Arg-OH).

6-10 week old female CD-1 mice were injected with 2, 20, or 200 nmol of Compound 16 diluted in 200 μl of 10 mM Histidine, 5% Dextrose in the tail vein. These dose levels are equivalent to 0.01, 0.1 and 1 mg of conjugate, respectively. Vehicle only was used as the control group. Mice were observed 10 min, 1 hour, and 4 hours after injection and then daily until euthanasia at 3 or 14 days post dose. Mice were scored using a modified Body Condition Score (BCS) and activity level by visual inspection. Body weight was measured every 3 days. Blood was collected using terminal cardiac puncture and placed in serum separating tubes (SST microtainer). General chemistry screens were performed by Phoenix Central Laboratory. Major organs (brain, heart, kidney, liver, lungs, intestines, skin, and spleen) were dissected, placed in 10% buffered formalin, paraffin embedded, stained with hematoxylin and eosin, and evaluated by a board certified veterinary pathologist.

6-10 week female CD-1 mice were injected with 0.008, 0.08, or 0.8 mg (molar equivalent of conjugate) of native chlorotoxin (KNT-01), Compound 76 (KNT-02), or Compound 16 (KNT-03) free peptide diluted in 200 μl of 10 mM Histidine, 5% Dextrose in the tail vein. The mice were observed for 1 hour post injection for activity level.

Results. Mice were evaluated 10 minutes, 1 hour, and 4 hours after injection then once daily until euthanasia 3 or 14 days post treatment. Mice in the vehicle control and the 0.01 mg dose group were normal at all observation time points. Four out of six mice in the 0.1 mg group and six out of six animals in the 1 mg dose cohort exhibited a decrease in spontaneous motor activity, somnolence, and prostration approximately 1-3 minutes after the injection. Ptosis was noted in some mice. The hypoactive behavior lasted 30-60 minutes and all mice had completely recovered by the 4 hour observation time point. The mice were not unconscious or paralyzed. Breathing remained normal. Coloration remained normal without signs of cyanosis, red eyes, or lacrimation. The decrease in motor activity behavior lasted approximately 30-60 minutes after injection.

In order to ascertain if the decrease in motor activity level was due to the Compound 16 conjugate, additional mice were injected with the KNT-03 free peptide, or the related KNT-01 or KNT-02 free peptides. Similar to the Compound 16 conjugate, all of the mice injected with free peptides in the high dose (200 nmol) showed a decrease in activity level, somnolence, and prostration starting 3 minutes post injection. This indicated that the hypoactive effect resulted from the peptide backbone. Because the effect was observed in the free peptide with the native sequence, the transient hypoactivity was not a novel property created by the mutated Compound 16 peptide and/or conjugation to the dye. In addition, this transient behavior was only observed in mice. Rats and non-human primates injected with similar high doses of Compound 16 did not exhibit abnormal activity levels.

With the exception of the transient low activity immediately after injection all mice were clinically normal by visual inspection for the duration of the study. All mice had BCS3 scores at each health observation indicating the mice were healthy. Mice were weighed every three days until euthanasia. No dose related changes in body weight were observed (FIG. 67).

Blood was collected from each mouse after euthanasia, at 3 and 14 days post injection. The serum was analyzed with a general chemistry screen. No dose related changes were observed. Table 35 shows serum values for kidney and liver function tests. None of the mice had BUN levels greater than 40 mg/dl. Compound 16 was detected in the liver and kidney where it was eliminated in the urine. These tests indicate that Compound 16 did not damage the kidney and liver, even at high doses.

TABLE 35

Liver and Kidney Serum Chemistry Analysis

| Animal ID | Group | BUN (mg/dl) | Creatinine (mg/dl) | ALT (U/L) | AST (U/L) | GGT (U/L) |
|---|---|---|---|---|---|---|
| 3 Days | Control | 19 | 0.3 | 27 | 75 | 0 |
| | Control | 22 | 0.3 | 23 | 72 | 0 |
| | Control | 22 | 0.3 | 25 | 65 | 0 |
| | 0.01 mg | 24 | 0.2 | 30 | 86 | 0 |
| | 0.01 mg | 28 | 0.2 | 26 | 86 | 0 |
| | 0.01 mg | 23 | 0.4 | 29 | 77 | 0 |
| | 0.1 mg | 23 | 0.4 | 26 | 76 | 0 |
| | 0.1 mg | 25 | 0.3 | 25 | 83 | 0 |
| | 0.1 mg | 29 | 0.4 | 28 | 80 | 0 |
| | 1 mg | 22 | 0.3 | 29 | 76 | 0 |
| | 1 mg | 20 | 0.2 | 28 | 124 | 0 |
| | 1 mg | 31 | 0.4 | 35 | 74 | 0 |
| 14 Days | Control | 22 | 0.3 | 35 | 83 | 0 |
| | Control | 31 | 0.3 | 30 | 120 | 0 |
| | Control | 19 | 0.2 | 30 | 89 | 0 |
| | 0.01 mg | 21 | 0.2 | 26 | 80 | 0 |
| | 0.01 mg | 17 | 0.2 | 52 | 97 | 0 |
| | 0.01 mg | 24 | 0.2 | 32 | 109 | 0 |
| | 0.1 mg | 23 | 0.2 | 34 | 107 | 0 |
| | 0.1 mg | 19 | 0.2 | 30 | 117 | 0 |
| | 0.1 mg | 23 | 0.3 | 59 | 175 | 0 |
| | 1 mg | 31 | 0.2 | 40 | 81 | 0 |
| | 1 mg | 23 | 0.1 | 39 | 97 | 0 |
| | 1 mg | 20 | 0.2 | 36 | 206 | 0 |
| mean | | 16 | 0.3 | 42 | 84 | 3 |
| low | | 9 | 0 | 18 | 45 | 0 |
| high | | 24 | 0.4 | 71 | 182 | 19 |

Major organs were dissected 3 and 14 days after injection. All tissue was analyzed by a certified veterinary pathologist. There were no histologic findings attributed to administration of Compound 16 on day 3 or on day 14.

Example 16

Tolerability of Other Chlorotoxin Conjugate Compounds in Normal Mice

This example shows experimental analysis of tolerability of Compounds 1-720 in normal CD-1 mice.

Materials and methods are as in Example 15, but with Compounds 1-720.

Results. Mice are evaluated 10 minutes, 1 hour, and 4 hours after injection then once daily until euthanasia 3 or 14 days post treatment. Some mice exhibit a decrease in spontaneous motor activity, somnolence, and prostration approximately 1-3 minutes after the injection. In order to ascertain if the decrease in motor activity level is due to Compounds 1-720, additional mice are injected with the free peptides. All of the mice injected with free peptides show a decrease in activity level, somnolence, and prostration starting 3 minutes post injection. This indicates that the hypoactive effect results from the peptide backbone. Because the effect is observed in the free peptide with the native sequence, the transient hypoactivity is not a novel property created by Compounds 1-720 and/or conjugation to the dye. In addition, this transient behavior is only observed in mice. Rats and non-human primates injected with similar high doses of Compounds 1-720 do not exhibit abnormal activity levels.

With the exception of the transient low activity immediately after injection all mice are clinically normal by visual inspection for the duration of the study. All mice have BCS3 scores at each health observation indicating the mice are healthy. Mice are weighed every three days until euthanasia. No dose related changes in body weight are observed.

Blood is collected from each mouse after euthanasia, at 3 and 14 days post injection. The serum is analyzed with a general chemistry screen. No dose related changes are observed. None of the mice have BUN levels greater than 40 mg/dl. Compounds 1-720 are detected in the liver and kidney where they are eliminated in the urine. These tests indicate that Compounds 1-720 do not damage the kidney and liver, even at high doses.

Major organs are dissected 3 and 14 days after injection. All tissue was analyzed by a certified veterinary pathologist. There are no histologic findings attributed to administration of Compounds 1-720 on day 3 or on day 14.

Example 17

Imaging of Compound 16 in ND2:SmoA1 Mice with Medulloblastoma Tumors

This example shows targeting and illumination of medulloblastoma tumors and cells in a ND2:SmoA1 mouse model using Compound 16 and further shows clinical and pathological effects of high doses of Compound 16.

Medulloblastoma is the most common malignant solid tumor in children. Current therapy includes maximal safe surgical resection, irradiation, and chemotherapy. Complete surgical resection of the tumor heavily influences the prognosis of patients with medulloblastoma by conferring a 30% survival improvement over patients with residual disease. Patients with residual disease are considered high-risk for tumor progression and are treated with higher doses of radiation and chemotherapy. These patients have a greater risk of suffering from the deleterious side-effects of aggressive treatments while facing a lower chance of surviving their disease. The goal of near-complete surgical resection must be balanced with surgically accurate tumor removal because damaging healthy brain tissue could severely impair normal neurological functions. Strategies, such as Compound 16 guided surgery, are needed to improve complete and accurate tumor resection in patients with brain cancer increasing patient survival and reducing morbidity.

The ND2:SmoA1 (abbreviated SmoA1) mouse model of medulloblastoma on a C57BL/6 background was used to evaluate binding of Compound 16 to medulloblastoma tumor. These mice develop spontaneous medulloblastoma tumors in the cerebellum that closely resemble the human disease. These genetically engineered transgenic mice express a constitutively active smoothened mutant protein (SmoA1) driven by a 1-kb fragment of the neuroD2 promoter. This promoter is activated mainly in the cerebellar granule neuron precursors in the brain. This mouse model mimics the sonic-hedgehog pathway subtype of medulloblastoma. Symptomatic mice that were homozygous for the transgene were selected for enrollment in these studies. Clinical symptoms of brain cancer were detected using an open field cage evaluation. Symptoms include head tilt, hunched posture, ataxia, protruding skull, and weight loss.

To evaluate Compound 16 signal in normal brain, Nu/Nu mice received an intravenous injection of 6 nmol of Compound 16. These mice were administered 60 µL of 0.5 mg/ml (10 nmol/100 µl) through the tail vein (n=6). One day after injection, the mice were euthanized using $CO_2$ inhalation. The normal brain was then removed and imaged using the IVIS Spectrum (Perkin Elmer) with the 745 nm/820 nm excitation and emission filter set. Signal was analyzed using the Living Image software (Perkin Elmer) by drawing equal sized "regions of interest" (ROI's) within the brain tissue. SNR (signal to noise ratio) was calculated using the non-injected ROI and the average of the normal injected brains.

SmoA1 mice with moderate symptoms of medulloblastoma received an intravenous injection of 10 nmol of Compound 16. Mice were administered 100 µl of 0.5 mg/ml (10 nmol/100 µl) Compound 16 through the tail vein. One day after injection the mice were euthanized using CO2 inhalation. Ex vivo whole brain imaging was performed with the IVIS Spectrum (Perkin Elmer) using the 745 nm/820 nm excitation and emission filter set, and on the Odyssey CLx (Li-Cor Biosciences) near-infrared scanner using the 800 nm setting (785 nm excitation laser). The tissue was then frozen in Optimal Cutting Temperature medium (OCT, Tissue Tek) on dry ice or fixed in 10% neutral buffered formalin. The frozen tissue was sliced into 12 µm sections. Tissues were either scanned using the Odyssey CLx scanner or stained with hematoxylin and eosin (H&E) according to standard histological protocols. For brains that were fixed in 10% neutral buffered formalin, the tissue was processed, embedded, sliced, and H&E stained according to standard protocols at Histology Consultation Services. Slides were scanned on the Aperio Scanscope AT (Leica Biosystems) at 20× magnification. Images were analyzed using either Living Image software (Perkin Elmer) or Image Studio software (Li-Cor Biosciences) by measuring the fluorescent signal within a region of interest (ROI) drawn in each tissue image. Signal in tumor compared to normal tissue (SNR) was calculated using tumor and cortex measurements from the same brain. Analysis was performed in both the dorsal and ventral orientations due to variations in tumor location within the brain. Signal measurements from whole tissue ROI's were used for statistical analysis. Significance values were calculated using a one-tailed T-test of unequal variance.

SmoA1 mice with medulloblastoma were injected with Compound 16 and imaged one day later. Compound 16 was higher in tumor tissue compared to normal brain in all eight of the SmoA1 mice that were enrolled in the study. Signal in tumor tissue compared to normal brain was between 5.9 and 47. Four out of eight samples had considerably lower signal in the tumor which was near the lower level of detection for the IVIS Spectrum and the Odyssey scanner. Signal in unaffected cortex was 2.7-3.6 fold higher and signal in normal brains from Nu/Nu mice was the same as non-injected animals. Small foci of metastatic leptomeningeal spread were detected using Compound 16.

Background signal in normal brain due to non-specific binding or incomplete clearance was evaluated in mice that had been injected with 6 nmol of Compound 16. The non-injected animal had a background signal of $3.17 \times 10^7$ as expressed by radiant efficiency. One day after Compound 16 administration, the average radiant efficiency was $3.26 \times 10^7 +/- 2.5 \times 10^6$ (n=6) which was not appreciably higher than the brain sample that did not receive an injection with a SNR of 1.03. Compound 16 was sufficiently cleared from normal brain tissue without non-specific binding one day after injection.

Figure 20:
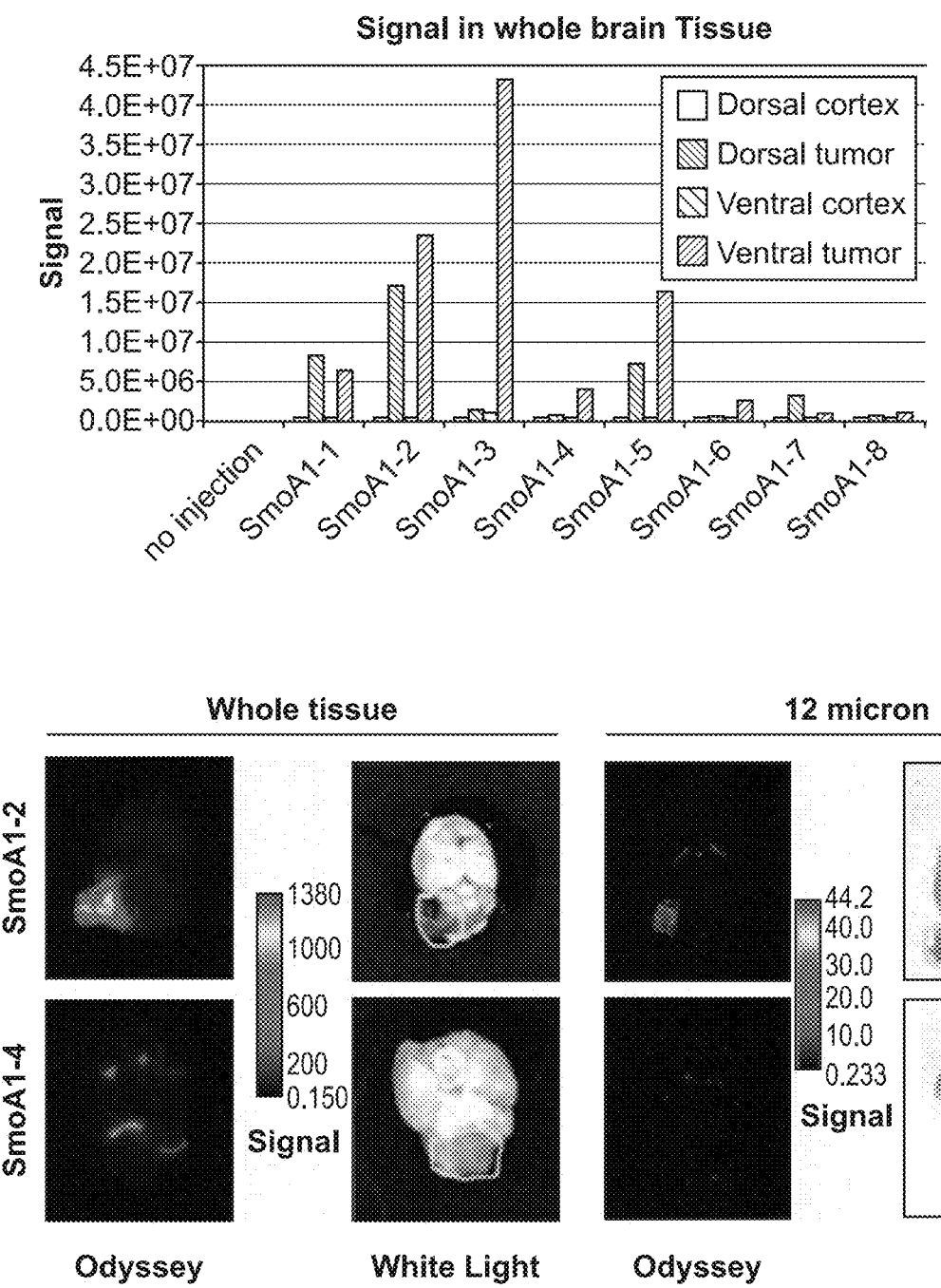
FIG. 20 shows signal and image analysis of tumor versus normal cortical tissue in SmoA1 mouse brain.
Figure 20:
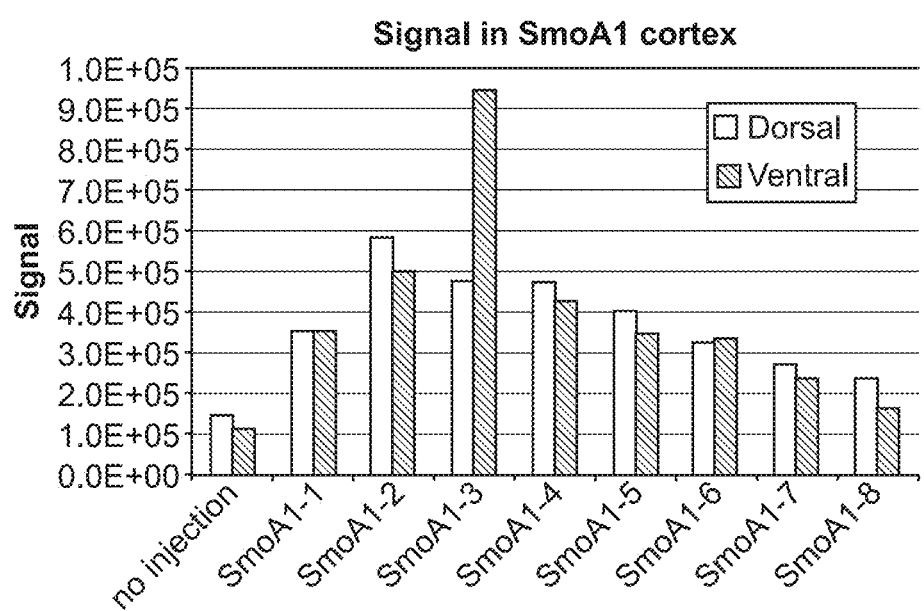

Compound 16 was analyzed in tumor bearing SmoA1 mice (n=8) with a 10 nmol dose one day after injection. Using whole brain analysis on the Odyssey, all eight samples had a higher signal in the tumor than the normal cortex (p=0.03). The fluorescent signal was noticeably lower in four out of eight tumors and near the lower limit of detection on both the IVIS Spectrum and the Odyssey scanner (FIG. 20). Signal in tumor compared to normal brain (SNR) was between 5.9 and 47.3 (FIG. 20). Signal in the cortex of the SmoA1 brain was 2.7-3.6 fold higher than the non-injected animal whereas the signal in the Nu/Nu normal brain was the same as the non-injected animal at the same time point (FIG. 20). The higher signal was possibly caused by the higher dose of Compound 16 that was used in SmoA1 mice or abnormalities that affect the entire SmoA1 brain. The SmoA1 mice often have mild to severe hydrocephalus which often affects clearance of Compound 16 from non-tumor tissue.

Figure 21:
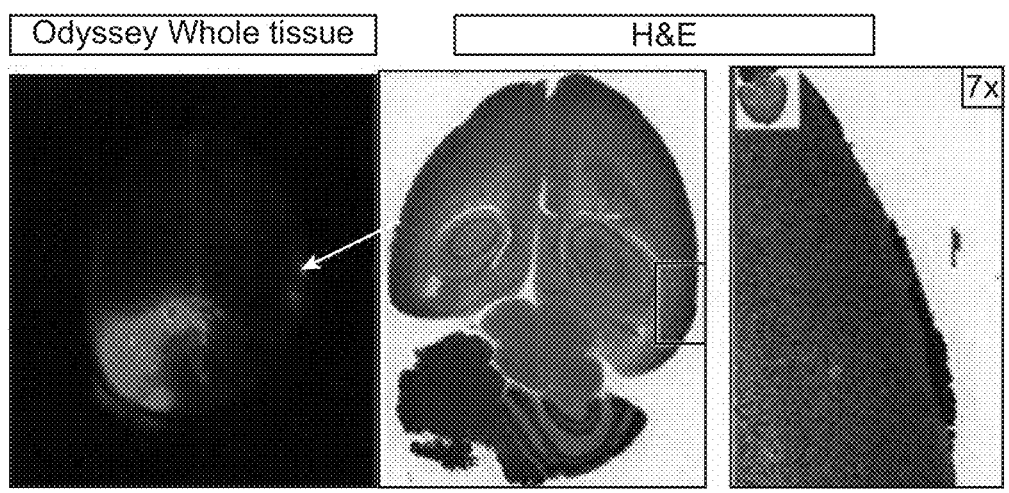
FIG. 21 shows small foci of fluorescence that correspond to small clusters of tumor cells highlighted in the H&E stained slide.

Leptomeningeal spread in SmoA1 mice was occasionally observed. These mice, like 30-35% of human patients, develop small foci of tumor cells in the meningeal membrane. Leptomeningeal spread was detected in one mouse using Compound 16. A whole brain fluorescent scan of SmoA1-1 is shown (FIG. 21). The scan illuminates small foci of fluorescence that corresponds to small clusters of tumor cells highlighted in the H&E stained slide (FIG. 21).

All mice with medulloblastoma had a higher signal in the tumor than normal cortex with SNR's ranging from 5.9-47 after administration of Compound 16. While the signal in tumor was higher than normal in all mice, four of the samples had noticeably lower signal in the tissue. Compound 16 signal was not detected in mice with normal brain tissue (Nu/Nu mice) while signal in unaffected SmoA1 cortex was 2.7-3.6 fold higher than the non-injected animals. The residual background signal in non-tumor tissue is possibly caused by hydrocephalus which occurs often in these mice. Small foci of metastatic cells were detected using Compound 16 in one mouse emphasizing Compound 16's capability to detect even small clusters of cancerous tissue.

Example 18

Imaging of Other Chlorotoxin Conjugate Compounds in ND2:SmoA1 Mice with Medulloblastoma Tumors This example shows targeting and illumination of medulloblastoma tumors and cells in a ND2:SmoA1 mouse model using Compounds 1-720 and further shows clinical and pathological effects of high doses of Compounds 1-720.

The ND2:SmoA1 (abbreviated SmoA1) mouse model of medulloblastoma on a C57BL/6 background is used to evaluate binding of Compounds 1-720 to medulloblastoma tumor.

Materials and methods are as in Example 17.

SmoA1 mice with medulloblastoma are injected with Compounds 1-720 and imaged one day later. Compounds 1-720 is higher in tumor tissue compared to normal brain in all eight of the SmoA1 mice that are enrolled in the study. Background signal in normal brain due to non-specific binding or incomplete clearance is evaluated in mice that have been injected with 6 nmol of Compounds 1-720. Compounds 1-720 is sufficiently cleared from normal brain tissue without non-specific binding one day after injection.

Compounds 1-720 analyzed in tumor bearing SmoA1 mice has a higher signal in the tumor than the normal cortex.

Leptomeningeal spread in SmoA1 mice is occasionally observed and is detected using Compounds 1-720.

Mice with medulloblastoma have a higher signal in the tumor than normal cortex. Compounds 1-720 signal is not detected in mice with normal brain tissue (Nu/Nu mice) while signal Small foci of metastatic cells are detected using Compounds 1-720 emphasizing the capability of Compounds 1-720 to detect even small clusters of cancerous tissue.

Example 19

Detection of Naturally Occurring Solid Tumors in Dogs

This example describes methods for detecting naturally occurring solid tumors in dogs using the fluorescently labeled chlorotoxin conjugate, BLZ-100.

Many types of canine tumors resemble human disease, including sarcomas, breast and lung cancers, mucosal squamous cell cancers, and gliomas. The diversity of these spontaneously occurring tumors in size and type, surrounding tissue, and patient body mass provides a model that is superior to the mouse in predicting the clinical characteristics of a chlorotoxin conjugate, such as BLZ-100, including tumor penetration, background staining, and effective imaging dose.

Methods:

Twenty-eight dogs undergoing planned solid tumor resection were enrolled in the study. All options were discussed and client consent was obtained under an approved IACUC protocol. Dogs received standard of care including tumor resection with intent to control or cure local disease. Dogs received BLZ-100 intravenously 24-48 hours before surgery, and tissues were imaged ex vivo after surgery. Ex vivo imaging was performed on gross tissue specimens using the IVIS Spectrum (PerkinElmer) and the Odyssey NIR scanner (Li-Cor) to determine overall signal in tumor and gross signal to background. Tissues were embedded in OCT, sectioned on a cryostat, and scanned on the Odyssey. Serial sections were stained with H&E, and comparison with the fluorescence scans was used to validate the specificity of BLZ-100 for tumor tissue. Intraoperative imaging was conducted in several cases, using a prototype open NIR imaging device.

Dose Preparation:

BLZ-100 was prepared in a formulation buffer (100 mM histidine/5% dextrose, 10 mM Tris/5% dextrose, or 10 mM Tris/5% mannitol). For all dose batches, lyophilized conjugate was suspended in formulation buffer. The material was drawn up into a sterile syringe, and then aliquoted through a sterile 0.44 micron filter into pre-capped sterile amber glass vials. The vials were stored at −20° C., and were shipped on dry ice to the study site.

Patients and Dose Administration:

Twenty-eight dogs with spontaneously-occurring solid tumors were enrolled in the study. Tumor types included several subtypes of sarcoma; oral and cutaneous squamous cell carcinomas; mast cell tumors; adenocarcinomas including lung, mammary, and thyroid; and a brain meningioma.

BLZ-100 was given intravenously 24-48 hours prior to surgery. Complete blood count, serum chemistry, and urinalysis data from prior to, and 24-48 hours post injection, were evaluated for changes that might indicate toxicity from the CTX. There were small declines in serum BUN, calcium, and potassium levels and in urine pH that reached statistical significance (two-tailed t-test); however, they remained well within the normal ranges and were not considered clinically significant. There were no other significant differences, and no overt safety concerns noted.

Nearly all dogs experienced an immediate pseudoallergy/hypersensitivity reaction within 10 minutes of dosing, characterized by erythema, mild to severe pruritus, and less commonly swelling of the muzzle and distal extremities. The severity of the reactions was not related to dose level or rate of administration. The reactions were self-limiting, ameliorated by diphenhydramine, and were completely resolved within 4 hours in all cases. These observations are consistent with a systemic release of histamine, which has been reported for a wide variety of drugs. Some dogs (mast cell tumor and CNS tumor patients) were receiving corticosteroids as part of their standard management, but corticosteroids were not required for management of reactions in any patient. No other systemic changes were identified. All dogs tolerated anesthesia and surgery normally. There were no apparent surgical complications associated with BLZ-100.

Patients 13-17 had surgery 2 days after BLZ-100 administration. This was done in order to evaluate the impact of time on tumor to background ratio. Since no consistent improvement was seen, the remainder of the patients had surgery 1 day after BLZ-100 administration.

Pharmacokinetics:

Serum samples were collected at time points following dose administration. A fluorescence assay was used to calculate the serum concentration of BLZ-100. The data show a rapid distribution into tissues, followed by a slower elimination phase. These data are similar to those obtained from laboratory mice, rats, dogs, and non-human primates.

Example 20

Detection of Naturally Occurring Solid Tumors in Dogs Using Chlorotoxin Conjugate Compounds

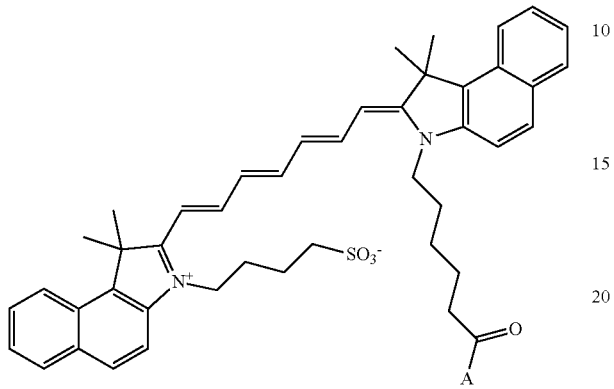

Compound 16

A=MCMPCFTTDHQMARRCDDCCGGR GRGKCYGPQCLCR (K-27 is Point of Attachment)

This example describes methods for detecting naturally occurring solid tumors in dogs using Compound 16.

Materials and methods used were as in Example 19. Patient characteristics, tumor type and site, body weight, and dose information are summarized in Table 36.

TABLE 36

Summary of tumor characteristics, patient data and dose administered

| Patient | Tumor Type | Site | Breed | Sex | Age (yr) | Weight (kg) | Dose (mg) |
|---|---|---|---|---|---|---|---|
| 1 | Soft-tissue sarcoma | Subcutaneous | Labrador mix | M | 11.7 | 24 | 0.375 |
| 2 | Adenocarcinoma | Lymph node | Poodle mix | M | 6.5 | 6.7 | 0.1 |
| 3 | Fibrosarcoma | Subcutaneous | Rhodesian Ridgeback | F | 11.7 | 39.1 | 0.3 |
| 4 | Hemangiosarcoma | Jaw | Labrador Retriever | M | 10.7 | 30.9 | 0.3 |
| 5 | Mastocytoma | Cutaneous | Labrador Retriever | F | 10 | 30.5 | 0.5 |
| 6 | Mastocytoma | Cutaneous | Pit Bull Terrier | F | 5.3 | 26 | 0.5 |
| 7 | Adenocarcinoma | Lung | American Eskimo | F | 11 | 14.3 | 0.5 |
| 8 | Squamous cell | Jaw | English Springer Spaniel | M | 5 | 25.8 | 0.5 |
| 9 | Chondrosarcoma | Nasal | Labrador mix | F | 8.4 | 29.4 | 1 |
| 10 | Adenosquamous carcinoma | Mammary | Pit Bull Terrier mix | F | 7 | 22.1 | 0.9 |
| 11 | Soft-tissue sarcoma | Mammary | Yorkshire Terrier | F | 7 | 3.8 | 0.4 |
| 12 | Soft-tissue sarcoma | Subcutaneous | Border Collie mix | F | 3.9 | 27.9 | 1 |
| 13 | Hemangiopericytoma | Subcutaneous | Standard Poodle | F | 7 | 33.7 | 1 |
| 14 | Squamous cell carcinoma | Cutaneous | Pit Bull Terrier | F | 11.8 | 28 | 1 |
| 15 | Squamous cell carcinoma | Jaw | Springer Spaniel | M | 8.3 | 23 | 1 |
| 16 | Fibrosarcoma | Jaw | Golden Retriever | F | 10.7 | 39.6 | 1.5 |
| 17 | Fibrosarcoma | Jaw | Chesapeake Bay Retriever | M | 5 | 44.4 | 1.5 |
| 18 | Mastocytoma | Cutaneous | English Bulldog | F | 9 | 29.3 | 0.8 |
| 19 | Soft-tissue sarcoma | Subcutaneous | Labrador Retriever | F | 10.3 | 25.6 | 1 |
| 20 | Follicular carcinoma | Thyroid | Golden Retriever | F | 7 | 37.7 | 1 |

TABLE 36-continued

Summary of tumor characteristics, patient data and dose administered

| Patient | Tumor Type | Site | Breed | Sex | Age (yr) | Weight (kg) | Dose ( mg) |
|---|---|---|---|---|---|---|---|
| 21 | Adenocarcinoma | Thyroid | Boxer | F | 6.3 | 25.2 | 1 |
| 22 | Adenocarcinoma | Mammary | Brittany Spaniel | F | 7 | 22.2 | 1 |
| 23 | Squamous cell carcinoma | Cutaneous | Golden Retriever | F | 9.1 | 34.4 | 1 |
| 24 | Adenocarcinoma | Mammary | Labrador mix | F | 13.3 | 21.8 | 0.75 |
| 25 | Soft-tissue sarcoma | Subcutaneous | Golden Retriever | F | 13.1 | 39 | 1 |
| 26 | Soft-tissue sarcoma | Subcutaneous | Chow mix | F | 6.1 | 33 | 1 |
| 27 | Meningioma | Brain | Border Collie | F | 13.2 | 17.3 | 1 |
| 28 | Hemangiosarcoma | Vertebral body | Golden Retriever | M | 10.8 | 32 | |

Serum samples were collected at time points following dose administration. A fluorescence assay was used to calculate the serum concentration of Compound 16. The data show a rapid distribution into tissues, followed by a slower elimination phase (Table 37).

TABLE 37

Serum Compound 16 levels in dogs, measured by standard curve analysis of fluorescence at time points following dosing. Serum samples from each time point were diluted 1:1 in formulation buffer. A standard curve of Compound 16 (10 mcg/ml to 4 ng/ml) in 50% serum/50% formulation buffer was prepared. Fluorescence was measured on the Odyssey scanner (765 nm excitation/800 nm emission). Serum concentrations of the product were back-calculated using the standard curve.

| | | Nominal time point (hr): | | | |
|---|---|---|---|---|---|
| | | 0.25 | 1 | 4 | 24 | 48 |
| Patient | Dose (mg/m$^2$) | Calculated serum BLZ-100 concentration, ng/ml | | | | |
| 1 | 0.44 | 520.49 | 31.51 | 2.21 | 1.30 | |
| 2 | 0.28 | 91.78 | 332.41 | 28.63 | 1.53 | |
| 3 | 0.25 | 1358.79 | 105.62 | 61.22 | 11.87 | |
| 4 | 0.30 | 140.20 | 48.15 | 11.42 | 2.91 | |
| 5 | 0.50 | 140.70 | 42.22 | 14.96 | 2.31 | |
| 6 | 0.56 | 161.12 | 42.53 | 6.93 | 1.20 | |
| 7 | 0.83 | 262.08 | 56.84 | 14.04 | 1.37 | |
| 9 | 1.03 | 2277.50 | 103.09 | 84.62 | 1.14 | |
| 10 | 1.12 | 634.11 | 206.93 | 12.78 | 2.92 | |
| 11 | 1.62 | 1685.95 | | 620.00 | 1.31 | |
| 12 | 1.06 | 8243.41 | 716.46 | 17.08 | 4.92 | |
| 13 | 0.94 | 862.19 | 149.60 | 14.84 | | 0.69 |
| 14 | 1.06 | 1561.45 | 193.46 | 20.00 | | 0.53 |
| 15 | 1.21 | 1668.98 | 121.85 | 20.70 | | 0.95 |
| 16 | 1.26 | 405.91 | 93.91 | 20.39 | | 1.16 |
| 17 | 1.17 | 160.69 | 164.74 | 2.89 | | 0.71 |
| 18 | 0.82 | 2084.98 | 324.36 | 29.74 | 0.81 | |
| 19 | 1.13 | 268.25 | 121.42 | 15.08 | 1.77 | |
| 20 | 0.87 | 1896.58 | 232.80 | 195.14 | 1.31 | |
| 21 | 1.14 | 928.75 | 23.97 | 3.28 | 1.02 | |
| 22 | 1.24 | 1069.51 | 129.34 | 17.07 | 0.74 | |
| 23 | 0.93 | 19698.61 | 1921.64 | 214.52 | 12.96 | |
| 24 | 0.94 | 18009.88 | 514.70 | 173.52 | 6.44 | |
| 25 | 0.85 | 666.06 | 902.32 | 60.58 | 8.33 | |
| 26 | 0.95 | 17754.16 | 1516.42 | 231.49 | 8.48 | |
| 27 | 1.47 | 3008.52 | 1183.35 | 107.49 | 11.18 | |

Example 21

Detection of Naturally Occurring Solid Tumors in Dogs Using Other Chlorotoxin Conjugate Compounds This example describes methods for detecting naturally occurring solid tumors in dogs using Compounds 1-720.

Materials and methods are as in Example 19 but with Compounds 1-720.

Serum samples are collected at time points following dose administration. A fluorescence assay is used to calculate the serum concentration of Compounds 1-720. The data show a rapid distribution into tissues, followed by a slower elimination phase. These data are similar for laboratory mice, rats, dogs, and non-human primates.

Example 22

Pharmacokinetics and Tolerability of Compound 16

This example demonstrates the pharmacokinetic (PK) profile of Compound 16 following a single intravenous (IV) injection in mice, rats, dogs, and monkeys. Pilot studies performed in all four species were used to estimate exposure and inform the study design of definitive GLP studies. PK samples from these studies were analyzed using research-based methods. The PK of Compound 16 following IV administration was evaluated as part of GLP single dose toxicology studies in rats and monkeys. In the GLP studies, serum Compound 16 concentrations were determined using validated LC/MS-based methods.

In this example, Compound 16 was intravenously administered as a single-use intraoperative fluorescent imaging agent to specifically label tumor tissue. Compound 16 was sterilely formulated in a liquid at 2 mg/mL in Tris/mannitol buffer at neutral pH. The dye was chemically linked via a single lysine residue on the CTX peptide. Compound 16 contained no novel excipients or linker molecules. A tabular listing of the single-dose nonclinical toxicity studies conducted to support initiation of first-in-human (FIH) clinical trials of Compound 16 is provided in Table 38.

TABLE 38

Tabular Listing of Single-Dose Toxicity Studies of Compound 16

| Study No. | Study Title | Testing Facility | GLP | Compound 16 Dose and Route | Status |
| --- | --- | --- | --- | --- | --- |
| RPT0031 | Pilot Tolerability of Compound 16 and Unconjugated KNT-03 in CD1 Mice | Blaze Bioscience Seattle, WA | No | 0.01, 0.1, 1 mg IV | Completed |
| 10777 | Toxicology and Toxicokinetic Study of Compound 16 in Male Sprague Dawley Rats | Xenometrics Stilwell, KS | No | 0.03, 0.3, 1.5 mg IV | Completed |
| 10865 | Single-dose Intravenous Toxicity and Toxicokinetic Study of Compound 16 in Sprague Dawley Rats | Xenometrics Stilwell, KS | Yes | 0, 0.07, 0.7, 7 mg IV | Completed |
| BRT 20140605 | Evaluation fo the Effect of Compound 16 on Complement Activiation and Basophill/Mast Cell Activation using Canine In vitro Test Systems | Burleson Research Technologies Morrisville, NC | No | 0, 100, 1000, 10,000 ng/mL | Results pending |
| 10803 | Pilot Pharmacokinetics Study of Compound 16 Following IV Administration to Male Beagle Dogs. This study includes safety evaluation endpoints. | Xenometrics Stilwell, KS | No | 1 mg IV | Completed |
| 11265 | Mechanistic Study Of Pseudoallergy Response In Male Beagle Dogs From a Single IV Dose Of Compound 16 | Xenometrics Stilwell, KS | No | 1 mg IV | Results available, draft report in preparation |
| 10822 | Pilot Pharmacokinetics Study of Compound 16 Following IV Administration to Male Non-human Primates (Cynomolgus). This study includes safety evaluation endpoints. | Xenometrics Stilwell, KS | No | 0.6 mg IV | Completed |
| 814.02 | A Single Dose 14-Day Intravenous Toxicity Study of Compound 16 in Cynomolgus Monkeys | SNBL Seattle, WA | Yes | 0, 0.6, 6, 60 mg IV | Draft Report |

All species used for nonclinical safety evaluations were pharmacologically relevant for Compound 16 based on a high degree of sequence homology to the CTX peptide target. The rat and monkey were selected as the primary species for GLP toxicology studies based on the sequence homology to the CTX peptide target (97 and 100% respectively), suitability of the species for safety assessment (i.e., preference for rat over mouse), and lack of potential confounding effects (pseudoallergy/hypersensitivity reactions have been observed in the dog but not in the monkey). Toxicology studies were performed in accordance with Good Laboratory Practice (GLP) regulations. Applicable International Conference on Harmonization (ICH) and Food and Drug Administration (FDA) guidance documents were referred to during the development of the compound, most notably ICH S6(R1), S9 and M3(R2) and the FDA Guidance for Industry document "Developing Medical Imaging Drug and Biological Products Part 1: Conducting Safety Assessments".

The selection of dose levels and method of administration were based on initial mouse pharmacology models in which a dose level of 0.01 mg produced consistent tumor imaging. Since the preferred method of dose administration in the clinical trials is on a fixed basis (i.e., not adjusted for body weight or surface area), dose levels in the nonclinical safety studies were converted to fixed dose levels using estimated body surface area for each species. The dose level for humans was estimated using imaging data in mice and dogs (Table 39).

TABLE 39

Estimated Imaging Dose Levels Across Species

| Species (~Body Surface Area (BSA) $m^2$: kg body wt) | Dose (mg) | Dose (mg/$m^2$) | Dose (mg/kg) |
| --- | --- | --- | --- |
| Mouse (0.008 $m^2$: 0.02 kg) | 0.01 | 1.3 | 0.5 |
| Rat (0.039 $m^2$: 0.25 kg) | 0.07 | 1.8 | 0.28 |
| Dog (1 $m^2$: 30 kg) | 1 | 1 | 0.03 |

TABLE 39-continued

Estimated Imaging Dose Levels Across Species

| Species (~Body Surface Area (BSA) $m^2$: kg body wt) | Dose (mg) | Dose (mg/$m^2$) | Dose (mg/kg) |
|---|---|---|---|
| Monkey (0.25 $m^2$: 3kg) | 0.6 | 2.4 | 0.2 |
| Human (1.6 $m^2$: 60 kg) | 3 | 1.9 | 0.05 |

In single-dose non-GLP pilot studies, mice displayed transiently decreased spontaneous motor activity, somnolence and prostration following intraveneous (IV) administration of 0.1 and 1 mg of Compound 16. Transient salivation was the only finding in the pilot study in male rats following IV administration of 0.03, 0.3, or 1.5 mg Compound 16 0 IV. In male dogs, notable findings in the pilot study included pseudoallergy/hypersensitivity reactions (i.e., itching/scratching, warm ears, etc.) in 2 of 2 treated dogs during or immediately after IV administration of 1 mg Compound 16. The mechanism of the pseudoallergy has been further explored in 3 male beagle dogs following IV administration of 1 mg of Compound 16. A rapid rise in plasma histamine levels was noted in all dogs, coincident with the appearance of clinical signs. No changes in complement level were seen, suggesting Compound 16 acted directly on mast cells/basophils in the dog. In the pilot study in male Cynomolgus monkeys, there were no abnormal clinical observations following IV administration of 0.6 mg Compound 16.

In single-dose GLP toxicology studies, Compound 16 was well tolerated in rats and monkeys. There were no Compound 16-related adverse findings. The no observed adverse effect level (NOAEL) was the high dose of 7 mg, approximately 28 mg/kg, in rats and the high dose of 60 mg, approximately 20 mg/kg, in monkeys.

In safety pharmacology studies, there were minimal effects on hERG current amplitude in human embryonic kidney cells following treatment with 0.2, 0.6 or 2.0 µM Compound 16 and no effects on cardiovascular parameters or respiratory rate in conscious cynomolgus monkeys in response to administration of 0.6, 6 and 60 mg Compound 16. In a tumor imaging pharmacology study with safety evaluation endpoints, most dogs with spontaneous tumors exhibited pseudoallergy/hypersensitivity reactions after IV administration of 0.1 to 1.5 mg Compound 16.

Single-Dose Toxicity:

Pilot Tolerability of Compound 16 and Unconjugated Compound 16 in CD1 Mice. The objective of this example was to assess the tolerability of Compound 16 in groups of female CD-1. Mice (n=3 mice/group/time point) were given a single IV bolus injection of Compound 16 at fixed dose levels of 0.01, 0.1 or 1 mg which was the equivalent to 1, 10 and 100 times the tumor imaging dose in mice. Tolerability was assessed by clinical observations, serum chemistry and histopathology of several major organs. Animals were euthanized on study days 3 and 14.

At the dose of 0.01 mg, mice were clinically normal during all observation time points. A subset of mice at 0.1 mg and all mice at 1 mg exhibited a decrease in spontaneous motor activity, somnolence, and prostration occurring as rapidly as 1 minute post-dose. The hypoactivity lasted approximately 30 to 60 minutes. All mice returned to normal by the 4 hour observation time point and remained normal for the duration of the study. Similar clinical signs were seen when mice were injected with equimolar amounts of the peptide backbone of Compound 16.

Toxicology and Toxicokinetic Study of Compound 16 in Male Sprague Dawley Rats. Male rats (n=3/group) were intravenously administered a single bolus injection of Compound 16 at fixed dose levels of either 0.03, 0.3, or 1.5 mg. Rats were observed up to 48 hours post-dose and were euthanized on day 3 of the study. Tolerability was assessed by clinical observations, hematology, serum chemistry and gross pathology.

Transient treatment-related clinical signs were limited to salivation, which was observed at the 0.03 mg dose in 2 rats at 20 minutes and 1 hour post-dose, at the 0.3 mg dose in 2 rats at 20 minutes post-dose, and at the 1.5 mg dose in 1 rat at 20 minutes, 1 hour, and 2 hours post-dose. At the 0.03 mg dose (n=3 rats) and the 0.3 mg dose (n=2 rats), clear oral stain was observed 1 or 2 hours post-dose. No clear dose-response relationship was evident and clinical signs were resolved at 2 hours and before 4 hours post-dose. There were no apparent test article-related hematology, clinical chemistry, or gross pathology findings at any dose level.

Single Dose Intravenous Toxicity and Toxicokinetic Study of Compound 16 in Sprague Dawley Rats. Rats (n=10/sex/group) were intravenously administered a single bolus injection of Compound 16 at fixed dose levels of 0, 0.07, 0.7, or 7 mg. Half of the animals were observed up to day 3 of the study and were then euthanized. The remaining animals were observed up to day 15 of the study and were then euthanized (Table 40).

TABLE 40

Dose Groups for Single-Dose Toxicology Study in Rats

| Group No. | No. Animals (M/F) | Test Article | Fixed Dose (mg) | Dose Volume (mL/rat) | Dose Conc. (mg/mL) | Sacrifice Day 3 | Day 15 |
|---|---|---|---|---|---|---|---|
| A | 10/10 | Vehicle | 0 | 1.4 | 0 | 5/sex/group | 5/sex/group |
| B | 10/10 | Cmpd 16 | 0.07 | 0.35 | 0.2 | 5/sex/group | 5/sex/group |
| C | 10/10 | Cmpd 16 | 0.7 | 0.35 | 2 | 5/sex/group | 5/sex/group |
| D | 10/10 | Cmpd 16 | 7 | 1.4 | 5 | 5/sex/group | 5/sex/group |

Single Dose Intravenous Toxicity and Toxicokinetic Study of Compound 16 in Sprague Dawley Rats. There were no Compound 16-related adverse findings at any dose level based on clinical observations (e.g., including detailed open field assessments), mortality, body weights, food consumption, ophthalmology, clinical pathology (e.g., including hematology, coagulation, clinical chemistry and urinalysis), organ weights and histopathology (e.g., including the injection site). At 0.07 mg dose, a slight, transient salivation was seen in 1 male rat during open field assessment approximately 15 minutes post-dose. This observation was most likely related to Compound 16; however, no clear dose-response relationship was evident.

At the 7 mg dose, the gross pathology findings were limited to green discoloration of the kidneys on days 3 and 15 of the study. As noted above, there were no Compound 16-related findings on organ weights or microscopic findings at any dose level. The findings of green discoloration in kidneys are not considered adverse. As such, the NOAEL was considered the high dose of 7 mg, or approximately 28 mg/kg.

Evaluation of the Effect of Compound 16 on Complement Activation and Basophill/Mast Cell Activation using Canine In vitro Test Systems. Blood from beagle dogs (n=5) was used to prepare high complement container serum. Compound 16, at concentrations of 0 (negative control) 100, 1000, and 10000 ng/mL, was incubated in the dog serum for 30, 60 and 120 minutes at 37° C. in 96 well plate format. Cobra venom factor, which contains native CTX, was used as a positive control. Complement activation was measured by converting intact dog $C_3$ to the stable end product, human sC5b-9, which was quantified by ELISA. Activation of complement in dog serum by Compound 16 was assessed by subtracting the total amount of complement at baseline, prior to addition of Compound 16 from residual C3 at the various timepoints.

Basophil activation was measured in whole blood samples (n=3) isolated from dogs. Compound 16 at concentrations of 100, 1000, 10000 ng/mL was incubated with the whole blood samples for 10 or 60 minutes. Anti-canine IgE and N-formyl-methionyl-leucyl-phenylalanine (fMLP) were used as positive controls. The presence of histamine, as measured by ELISA, in the blood samples was used to assess basophil activation.

Pilot Pharmacokinetics Study of Compound 16 Following IV Administration to Male Non-Human Primates (Cynomolgus). Cynomolgus monkeys (n=2 males/group) were intravenously administered a single bolus injection of Compound 16 at a fixed dose level of 0.6 mg. Blood samples were collected for pharmacokinetics at pre-administration, 0.083, 0.25, 0.5, 1, 2, 4, 6, 24, 48, 72 and 96 hours post-dose. Clinical observations were made at each time point. There were no abnormal clinical observations up to 96 hours post-dose A Single Dose 14-Day Intravenous Toxicity Study of Compound 16 in Cynomolgus Monkeys. Cynomolgus monkeys (n=3/sex/group) were intravenously administered a single bolus of Compound 16 at fixed dose levels of 0, 0.6, 6, or 60 mg and were observed for 14 days (Table 41). Ophthalmic examinations were performed prior to dosing at study day -7 and on study day 11. The animals were euthanized on study day 15 and gross post-mortem examinations were performed.

There were no Compound 16-related adverse findings at any dose level based on mortality, clinical observations, body weights, ophthalmology, clinical pathology (e.g, including hematology, coagulation, serum chemistry and urinalysis), organ weights and histopathology (e.g., including the injection site). Neurological and musculoskeletal assessments were additional parameters added to the study and no test-article related changes were noted after once weekly assessments.

TABLE 41

Dose Groups for Single-Dose Toxicology Study in Monkeys

| Group No. | No. Animals/ (M/F) | Test Article | Fixed Dose (mg) | Dose Volume (mL) | Dose Conc. (mg/mL) |
|---|---|---|---|---|---|
| 1 | 3/3 | Vehicle | 0 | 12 | 0 |
| 2 | 3/3 | Cmpd 16 | 0.6 | 3 | 0.2 |
| 3 | 3/3 | Cmpd 16 | 6 | 3 | 2 |
| 4 | 3/3 | Cmpd 16 | 60 | 12 | 5 |

At 60 mg, green-colored urine was noted by gross examination in one male and three females at day 3 of the study day with no corresponding impact on urinary parameters or renal pathology. Urine from all animals was subjected to an exploratory fluorescence assay, which revealed a dose dependent increase in fluorescent signal intensity on day 3 of the study in all groups treated with Compound 16 compared to the control group which was not treated with Compound 16. On day 15 of the study, the fluorescent signal was lower compared to day 3, but still detected in most mid- and high-dose animals, but not the low-dose animals when compared to the control group. These results suggest drug was present in the urine, which possibly accounted for the green appearance of urine in the high dose animals. Therefore the NOAEL was considered to be the high dose of 60 mg or approximately 20 mg/kg.

Single bolus doses of Compound 16 administered intravenously were well-tolerated in mice, rats and monkeys. Treatment-related changes observed in mice included decreased spontaneous motor activity, somnolence and prostration at doses of 0.1 and 1 mg Compound 16. The hypoactivity was transient and occurred from 30 to 60 minutes post-dose. All mice were normal by 4 hours. These changes were not observed to-date in the clinical trials or in species other than mice. Clinical signs of transient salivation were observed in a pilot study in male rats at doses of 0.03, 0.3, or 1.5 mg Compound 16 following intravenous administration. However, salivation was not observed in the subsequent single-dose study performed in male and female rats at doses up to 7 mg of Compound 16 by intravenous administration, nor was salivation observed in any other species. In addition to the toxicity evaluations, no effects on heart rate, blood pressure, respiration rate or ECG tracings were observed in a safety pharmacology study in conscious monkeys.

In vitro hemolysis and local tolerance studies have not been conducted. Compound 16 is a biotechnology-derived pharmaceutical candidate that is formulated with commonly-used excipients, such as Tris buffer and D-mannitol. Importantly, (1) no treatment-related hematological findings were identified in the completed nonclinical safety studies or in the preliminary data from the on-going phase 1 clinical safety study in subjects with skin cancer and (2) no irritation or lesions at the injection site were identified by macroscopic examination or by histopathology in the single-dose, intravenous administration, or toxicology studies in rats and monkeys.

Genetic toxicology studies were not conducted with Compound 16 since it is not expected to react with DNA and the formulation does not contain any novel excipients. The dye is attached to the peptide via a stable, covalent amide bond. Nothing in the structure of the peptide, dye or attachment suggests the potential of mutagenicity. In addition, typical clinical use and exposure to Compound 16 will be of short duration, consisting of a single injection per subject, perhaps a single injection during a lifetime, with an estimated human plasma terminal half-life of approximately 1-2 days, into subjects clinically diagnosed with cancer. Examination of the chromatograms from the LC/MS pharmacokinetic methods has not revealed the presence of any major metabolites of Compound 16.

The peptide component of Compound 16 is similar to native CTX. A synthetic version of the CTX peptide (TM-601) has been studied in mice and marmosets and it was well-tolerated. The NOAEL for TM-601 after a single IV dose in the mouse was 6.4 mg/kg (highest dose tested) and 2.0 mg/kg in the marmoset (highest dose tested). Repeated-dosing for 7 weeks in mice at doses of 2 and 5 mg/kg by intravenous administration resulted in clinical signs of transient ptosis and hypoactivity within 1 hour post-dose. No effects on hematology or tissue pathology were observed.

The typical doses of ICG vary by indication, but generally range from 25 to 50 mg. By comparison, Compound 16 contains roughly 0.15 mg of dye per mg of drug product. Compound 16 imaging doses are currently estimated to range from 3 to 12 mg, or 0.45 to 1.8 mg equivalents of ICG.

In the pilot studies, Compound 16 PK profiles following IV administration demonstrated a bi-exponential decline with a rapid initial phase and a longer terminal phase in all species. In mice and rats, the terminal phase could not be well defined due to low concentrations and study design/assay limitations. However, overall systemic exposure appeared to be well characterized since the majority of the systemic exposure was accounted for in the first 4 to 8 hours following IV administration. In the pilot studies of dogs and monkeys, the apparent $t_{1/2}$ was approximately 55 hours in both species.

Following IV administration of Compound 16 in the rat and monkey single-dose GLP toxicology studies, exposure based on $C_{max}$ and $C_0$ increased in an approximately dose-proportional manner across the tested ranges. $AUC_{0-t}$ values increased in a dose-proportional or higher than dose-proportional manner. These observations suggested that Compound 16 clearance is reduced at higher doses.

At the highest dose group of 60 mg Compound 16 in monkeys, the serum concentration versus time profiles were adequately defined to estimate additional PK parameters dependent on characterization of the terminal phase. The overall mean $t_{1/2}$, CL, and $V_{ss}$ values were 33.7 hr, 50.6 mL/hr, and 211 mL, respectively.

Methods of Analysis:

Analytical Method for Quantitation of Compound 16 in Preclinical Species. Two main approaches have been used to quantify Compound 16 in serum. A fluorescence-based method was used in support of non-GLP studies in the mouse, dog, and monkey. This method was intended for research purposes only and was not subjected to method validation. Samples were analyzed in a 96-well format and quantification was achieved by comparison of measured fluorescence in the sample to a standard curve. An Odyssey CLx near infrared scanner (Li-Cor Biosciences) was used to measure signal from samples and standards, using the 800 nm channel (785 nm excitation). The studies in which this method was used are listed in Table 42.

TABLE 42

Listing of Studies for the Analytical Method of Quantitation of Compound 16

| Species (Method of Administration) | Lowest Standard Study Reference Number | Used (ng/mL) |
|---|---|---|
| CD-1 mouse (IV) | Research RPT0030 v02 | 14.6 |
| beagle dog (IV) | Xenometrics 10803 | 0.5 |
| cynomolgus monkey (IV) | Xenometrics 10822 | 0.5 |

LC/MS methods were developed and used to analyze serum from a non-GLP rat study and from GLP studies in rats and cynomolgus monkeys. The LC/MS methods were validated prior to GLP study sample analyses. The Lowest Level of Quantitation (LLOQ) for Compound 16 was 10 ng/mL and 5 ng/mL in rat and monkey serum, respectively. The studies in which these methods were used are listed in Table 43.

TABLE 43

Listing of Studies for the LC/MS Analysis of Compound 16 in Serum

| Species (Method of Administration) | Study Reference Number | LLOQ (ng/mL) |
|---|---|---|
| Sprague Dawley rat (IV) | Xenometrics 10777 | 10.0 |
| Sprague Dawley rat (IV) | Xenometrics 10865 | 10.0 |
| cynomolgus monkey (IV) | SNBL.814.02 | 5.0 |

The stability of rat serum samples stored at −70° C. was at least 9 months. Stability data from the monkey support serum sample storage up to 1 month at −70° C. Incurred sample reanalysis (ISR) was performed on samples from the rat and monkey GLP studies. The rat ISR assessment passed, however the monkey ISR did not. Follow-up investigations of the ISR failure in the monkey study were conducted in an attempt to identify a root cause and assess impact of the ISR failure on the study data. No single root cause was identified, however issues with sample stability and variability from the various lots of control serum and matrix likely contributed. It was noted that the failure rate was highest in samples with relatively low concentrations of Compound 16.

Analytical Method for Quantitation of Compound 16 in Humans. Based on the methods used to detect Compound 16 in rat and monkey serum, an LC/MS assay to detect Compound 16 in human serum was developed. This method differs from the validated preclinical methods used in rat and monkey in a few aspects. First, the internal standard used in the human method is an isotope-labeled version of Compound 16 which is approximately 30 Da heavier than the preclinical standard, Compound 76 (the peptide component of Compound 76 having a sequence of H-Met-Cys-Met-Pro-Cys-Phe-Thr-Thr-Asp-His-Gln-Met-Ala-Arg-Ala-Cys-Asp-Asp-Cys-Cys-Gly-Gly-Ala-Gly-Arg-Gly-Lys-Cys-Tyr-Gly-Pro-Gln-Cys-Leu-Cys-Arg-OH). Second, bovine serum albumin has been added to the standards and quality control solutions to improve stability. Third, an AB Sciex QTrap 5500 mass spectrometer was used in place of the Sciex API 5000. The LLOQ for the human assay is 10 ng/mL.

Pharmacokinetic Methods. Compound 16 serum concentration versus time data were downloaded into Phoenix WinNonlin 6.3 (Pharsight, Cary, N.C.) for analyses using standard noncompartmental methods of intravenous bolus, intravenous infusion, or extravascular input as appropriate. Mouse and rat PK data were analyzed using the mean serum concentration versus time data. Dog and monkey PK data were analyzed by individual animal and then group summary statistics were calculated. Samples that were not analyzed for Compound 16 concentration were due to insufficient sample volume or concentration values below the limit of quantitation of the assay. Such samples were treated as missing for the purpose of calculating toxicokinetic (TK) parameters, and were not included in the calculation of group means. Nominal dose and sample collection times were used in estimating parameters.

Absorption. Compound 16 was administered IV as the intended clinical route of administration is IV.

Figure 22:
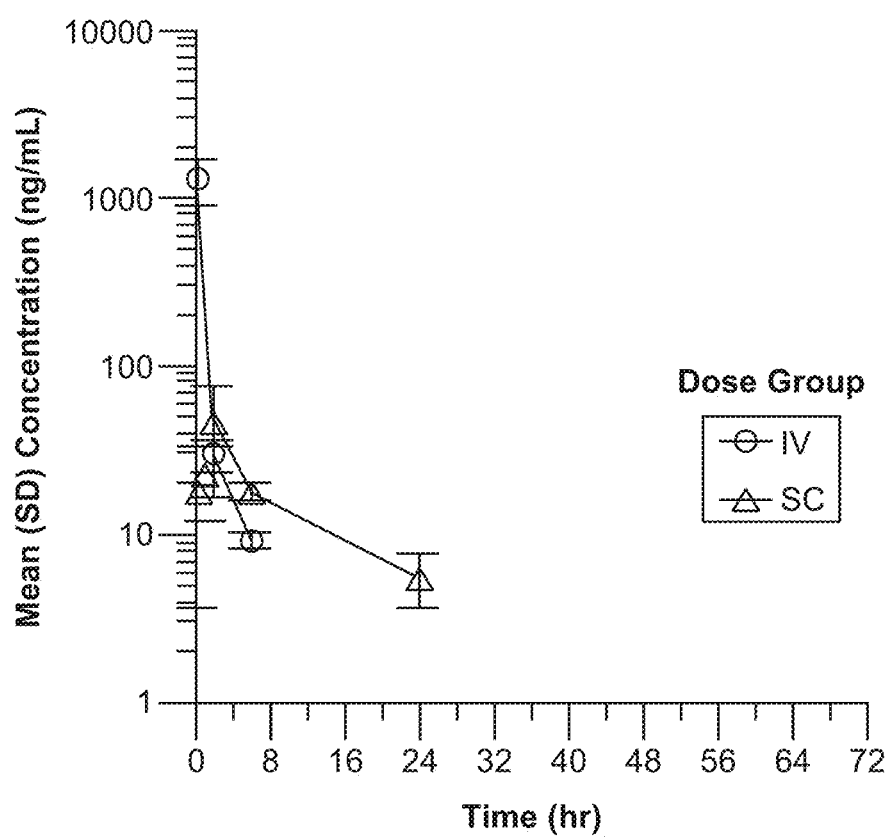
FIG. 22 shows the mean (SD) of serum BLZ-100 concentration vs. time profiles following a single intravenous bolus of 0.02 mg BLZ-100 administered to female mice.

Distribution:

Pharmacokinetics of Intravenous Administration of Compound 16 in Female CD-1 Mice. Female mice were intravenously or subcutaneously administered a single fixed dose of 0.02 mg of Compound 16. Compound 16 was formulated in 10 mM Tris/5% dextrose. Serum was collected from mice at 0.25, 2, 6 and 24 hours following administration (FIG. 22). A fluorescence-based method was used to measure Compound 16 serum concentrations.

Tolerability and Toxicokinetic Study of Compound 16 in Male Sprague Dawley Rats. Toxicokinetics (TK) were evaluated in male Sprague Dawley rats as part of a single dose tolerability study. Rats were intravenously administered a single fixed bolus dose of Compound 16 at one of two nominal dose levels, either 0.03 or 0.3 mg. Compound 16 was formulated in 10 mM Tris, 5% Mannitol, pH 7.2. Animals (n=3 per timepoint) were bled on a staggered sampling scheme at 0.083, 0.33, 1, 2, 4, 8, 24, and 48 hours after injection. An LC/MS method was used to measure Compound 16 serum concentrations.

Figure 23:
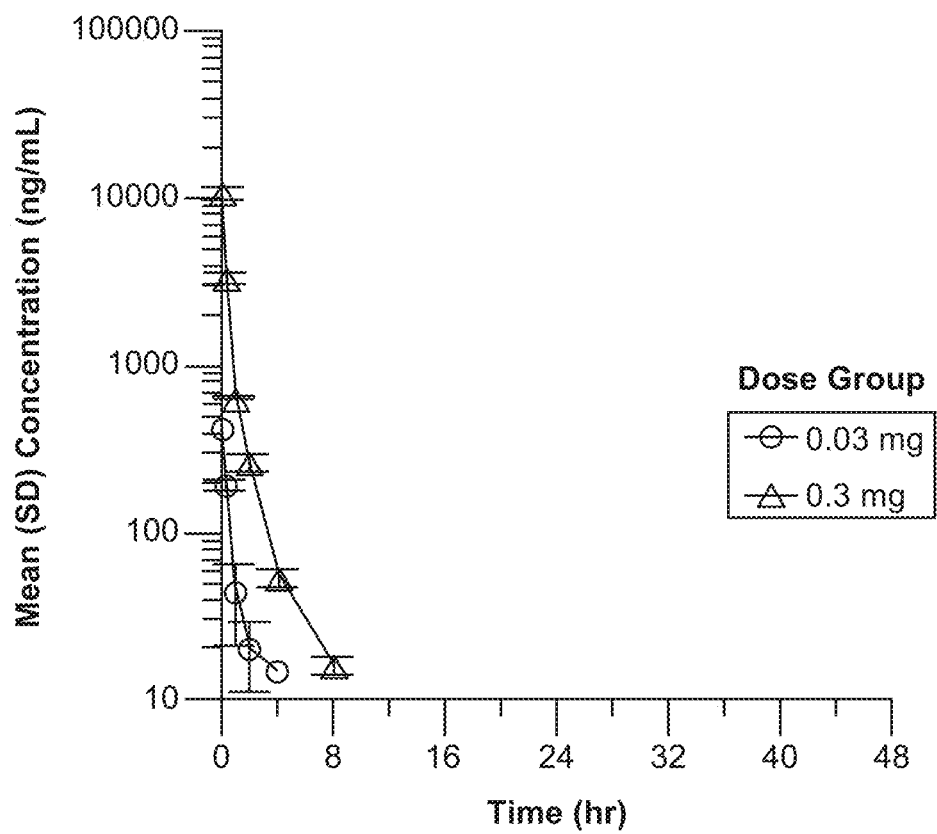
FIG. 23 shows the mean (SD) of serum BLZ-100 concentration vs. time profiles following a single intravenous bolus of 0.03 or 0.3 mg dose to male rats.

Following a single IV bolus, serum concentrations were measurable up to 4 hours in the 0.03 mg group and up to 8 hours in the 0.3 mg group (FIG. 23). Compound 16 exposure based on $C_0$ and $AUC_{0-t}$ increased in an approximately dose-proportional manner. Due to the limited measurable concentrations available in the PK profile, parameters based on the terminal phase could not be calculated.

Biodistribution was evaluated by measuring fluorescence intensity in tissue sections from the organs collected at euthanasia 48 hours after intravenous administration. Kidney, liver, heart, and aorta were collected and fixed in 10% formalin. Tissue was stored at 4° C. in 10% formalin until processed. The tissue was washed twice in PBS then processed through a sucrose gradient of 10% sucrose/PBS for 5 hours followed by 20% sucrose/PBS overnight at 4° C. for cryoprotection. The tissue was then gross sectioned and frozen in OCT on dry ice. The frozen tissue blocks were sliced into 12 μm sections and placed on gelatin coated slides. Slides were scanned using the Odyssey CLx imaging system (Li-Cor Biosciences) using the 800 nm channel (785 nm excitation). Images were analyzed using Image Studio software (Li-Cor Biosciences) by measuring the signal within a region of interest (ROI) for each sample. An average signal for three to four sections for each animal was calculated.

The signal emitted from Compound 16 was highest in the kidney which was consistent with renal clearance of the product. Less intense fluorescence was observed in liver and aorta. Signal was low in the heart. Signal increased with dose escalation in all of the tissues that were tested; however, the signal in the heart remained low even at high doses. Signal in the aorta and the great vessels of the heart was relatively high compared to the heart and increased with dose escalation. Distribution of Compound 16 to the kidney, liver, heart, and aorta did not seem to have toxicological significance. There were no corresponding changes in serum chemistry or histopathology.

Pilot Pharmacokinetics of Compound 16 Following Intravenous Administration to Male Beagle Dogs. Two male beagle dogs were intravenously administered a nominal dose of 1 mg of Compound 16. The first dog received the dose as an IV bolus and the second dog received the dose as a 15 minute IV infusion. Compound 16 was formulated in 10 mM Tris, 5% Mannitol, pH 7.2. Animals were bled for PK analysis at pre-dose, 0.083, 0.25, 0.5, 1, 2, 4, 6, 24, 48, 72, and 96 hour post-dose (bolus) or post-start of infusion. A fluorescence-based method was used to measure Compound 16 serum concentrations. (Table 44).

Following a single IV bolus to Dog X1, the $C_0$ value was consistent with an administered dose of 0.36 mg (0.36 mg/515 mL plasma volume in a dog. The $t_{1/2}$ was approximately 54 hours, CL was 1100 mL/hr, and $V_{ss}$ was 29900 mL which was approximately twice total body water (Davies and Morris 1993). (Table 44).

TABLE 44

Serum concentrations of Compound 16 (ng/ml) following a single intravenous dose (bolus or infusion) of 1 mg to male dogs, calculated by comparison to standard curve.

| Time (hr) | Dog X1 (IV bolus) | Dog X2 (15-min IV infusion) |
| --- | --- | --- |
| 0 | BLQ | BLQ |
| 0.083 | 391.89 | 54.61 |
| 0.25 | 209.5 | 225.74 |
| 0.5 | 73.74 | 36.84 |
| 1 | 68.24 | 22.89 |
| 2 | 10.43 | 6.18 |
| 4 | 2.63 | 1.61 |
| 6 | 1.58 | 1.13 |
| 24 | 1.32 | 0.56 |
| 48 | 0.81 | 0.32 |
| 72 | 0.52 | 0.21 |
| 96 | 0.44 | 0.18 |

BLQ = below limit of quantification.
Time = 0 is pre-dose.

Following a 15 minute IV infusion to Dog X2, the $t_{1/2}$ at 57 hours was consistent with that of Dog X1. However, $C_{max}$ was approximately 40% lower relative to the IV bolus $C_{max}$. Overall exposure based on AUC following the infusion was approximately 55% lower than that observed following the IV bolus dose. This corresponded to faster CL and higher $V_{ss}$ values relative to the IV bolus dose. It is unknown if this observed difference in CL and $V_{ss}$ is due to a true PK difference between the animals or dosing routes, or an artifact of issues with the dosing solution and a potentially incomplete priming of the infusion line, leading to a lower than expected administered dose. (Table 44).

Figure 24:
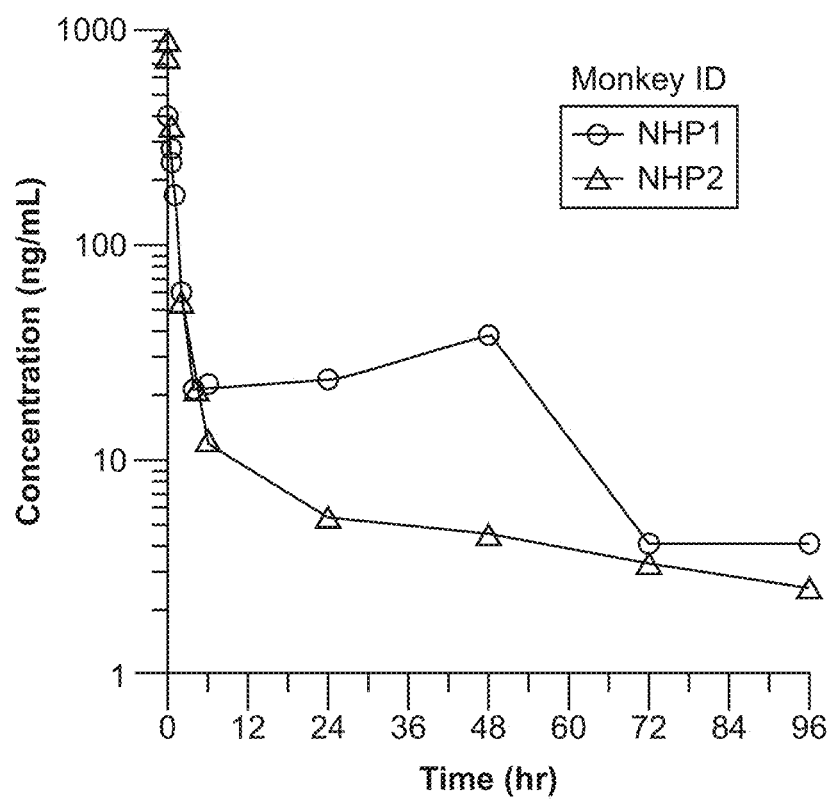
FIG. 24 shows the individual serum BLZ-100 concentration vs. time profiles following a single intravenous bolus dose of 0.6 mg to male monkeys.

Pilot Pharmacokinetics of Compound 16 Following IV Administration to Male Non-Human Primates. Two cynomolgus monkeys were administered a nominal dose of 0.6 mg of Compound 16 as an IV bolus. Compound 16 was formulated in 10 mM Tris, 5% Mannitol, pH 7.2. Animals were bled for PK analysis at predose, 0.083, 0.25, 0.5, 1, 2, 4, 6, 24, 48, 72, and 96 hours postdose. A fluorescence-based method was used to measure Compound 16 serum concentrations (FIG. 24).

Although $C_{max}$ or $C_0$ values were variable between males and females, there was no obvious overall trend based on these parameters that would indicate an effect of sex. $AUC_{0-t}$ was consistent between males and females across all dose groups.

TABLE 45

Mean non-compartmental Compound 16 PK Parameters Following a Single IV Bolus Dose to Male and Female Sprague Dawley Rats. Note: Due to the unequal number of samples with measurable Compound 16 concentrations between males and females at certain timepoints, some overall dose group (male +female) exposure parameters do not equal the average of the corresponding male and female exposure values.

| Dose (mg) | Sex | $C_{max}$ (ng/mL) | $C_0$ (ng/mL) | $AUC_{0-t}$ (hr*ng/mL) |
|---|---|---|---|---|
| 0.07 | Male | 789 | 1500 | 821 |
|  | Female | 541 | 921 | 700 |
|  | Male + Female | 665 | 1200 | 794 |
| 0.7 | Male | 8130 | 16400 | 8130 |
|  | Female | 6880 | 11000 | 7850 |
|  | Male + Female | 7510 | 13400 | 8070 |
| 7 | Male | 83300 | 117000 | 127000 |
|  | Female | 95400 | 155000 | 134000 |
|  | Male + Female | 89400 | 136000 | 130000 |

The shape of monkey NHP1's serum concentration versus time profile was not what would be expected following a single IV bolus dose (Table 44). The reason is unknown and these data could not be used to calculate PK parameters that require definition of the terminal phase of the concentration versus time profile. The $t_{1/2}$ for NHP2 was approximately 55 hours, CL was 170 mL/hr, and $V_{ss}$ was 6580 mL.

Figure 25:
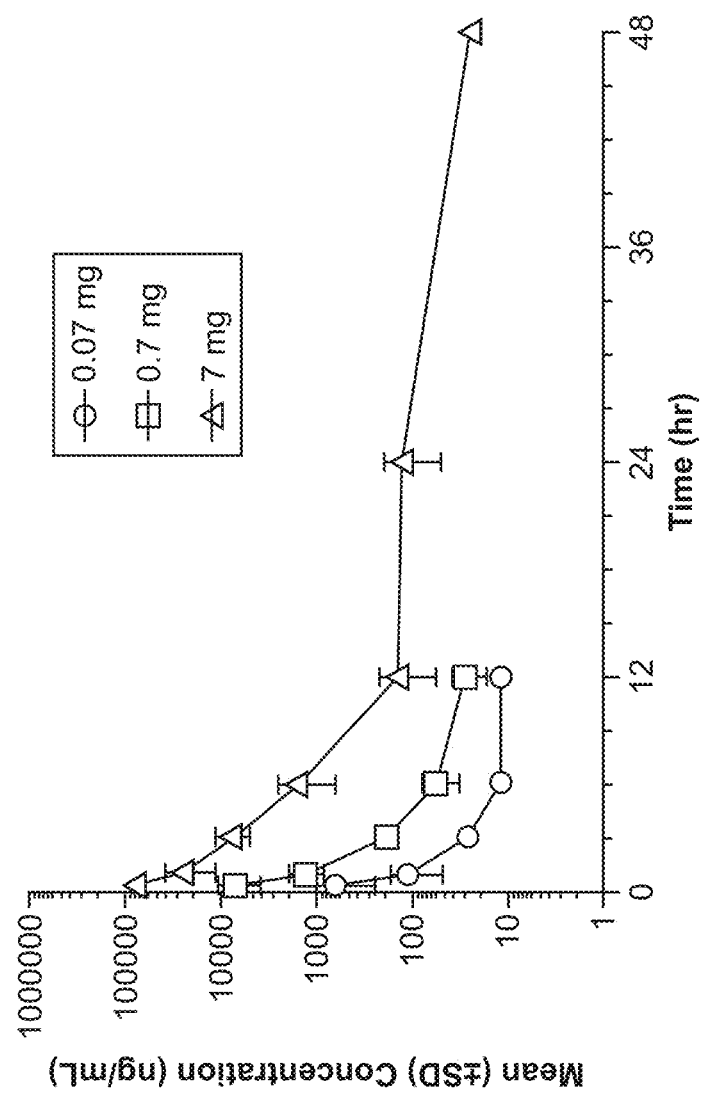
FIG. 25 shows the mean (±SD) BLZ-100 serum concentrations (ng/mL) summarized by dose following a single intravenous bolus dose to male and female rats.

Single Dose Intravenous Toxicity and Toxicokinetic Study of Compound 16 in Sprague Dawley Rats. Male and female Sprague Dawley rats were administered a single IV bolus dose of Compound 16 at fixed doses of 0.07, 0.7, and 7 mg. Compound 16 was formulated in 10 mM Tris, 5% Mannitol, pH 7.2. PK samples were obtained using a staggered sampling scheme of 3 males and 3 females per timepoint per group at pre-dose, 0.25, 1, 3, 6, 12, 24, and 48 hours post-dose (FIG. 25). Serum samples were analyzed for Compound 16 concentration via a validated LC/MS based procedure and the resulting concentration versus time data were used to estimate TK parameters using non-compartmental analysis.

Following a single fixed IV bolus dose of Compound 16, mean serum concentrations were measurable out to 12 hours post-dose with an LLOQ of 10 ng/mL in the 0.07 and 0.7 mg dose groups and out to 48 hours post-dose in the 7 mg dose group. Exposure based on $C_{max}$ and $C_0$ increased in an approximately dose-proportional manner across the tested dose range. $AUC_{0-t}$ was approximately dose-proportional between the 0.07 and 0.7 mg dose levels, and increased in a higher than dose-proportional manner between the lower dose groups versus the 7 mg dose level (see Table 45).

A Single Dose 14-Day Intravenous Toxicity Study of Compound 16 in Cynomolgus Monkeys. Male and female cynomolgus monkeys (n=3 males and 3 females per group) were administered a single IV bolus dose of Compound 16 at fixed doses of 0.6, 6, and 60 mg. Compound 16 was formulated in 10 mM Tris, 5% Mannitol, pH 7.2. PK samples were obtained pre-dose, 0.083, 0.25, 1, 2, 4, 8, 12, 24, 36, 48, 72, 96, and 120 hours post-dose. Serum samples were analyzed for Compound 16 concentration using a validated LC/MS based procedure and the resulting concentration versus time data were used to estimate TK parameters using non-compartmental analysis.

Figure 26:
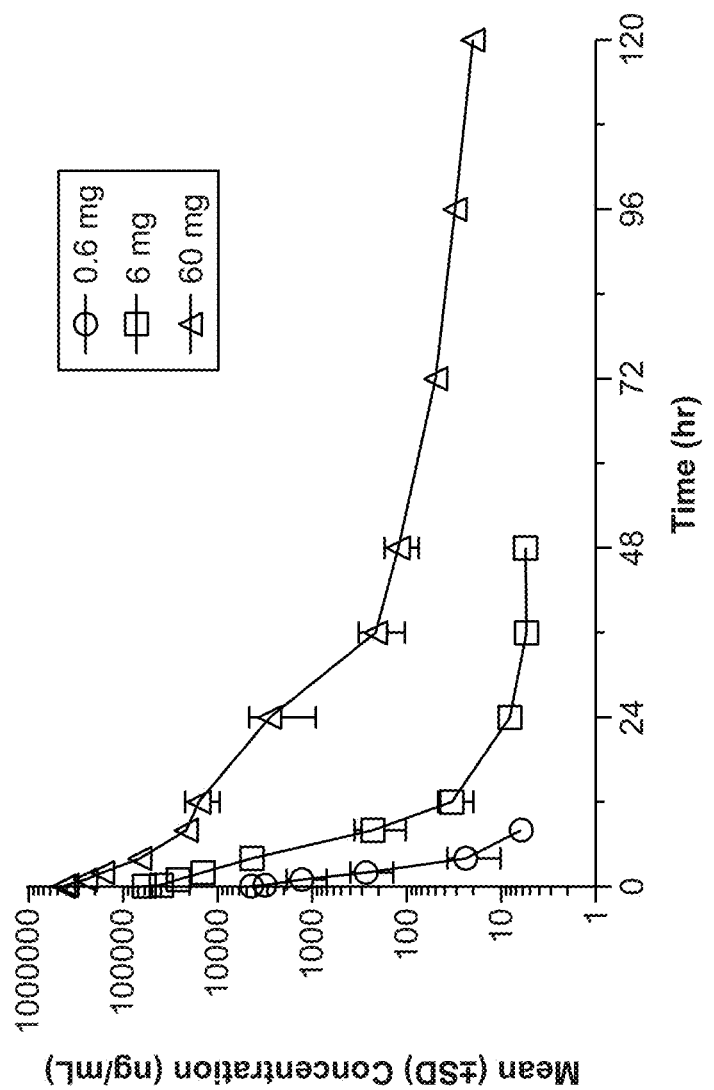
FIG. 26 shows the mean (±SD) BLZ-100 serum concentrations (ng/mL) summarized by dose following a single intravenous bolus dose to male and female monkeys.

Mean serum concentrations of greater than 5 ng/mL were measured at 8, 48, and 120 hours post-dose in the 0.6, 6, and 60 mg dose groups, respectively (FIG. 26). Exposure based on $C_0$ and $AUC_{0-t}$ was 6 to 29% higher in females relative to males across the tested dose levels (see Table 46). This is potentially due to the female monkeys' smaller size relative to the male monkeys since Compound 16 was administered as a fixed dose, rather than based on body weight. However, all dose-dependent trends in exposure were consistent between the sexes.

TABLE 46

Mean Non-compartmental Compound 16 PK Parameters Following a Single IV Bolus Dose to Male and Female Cynomolgus Monkeys.

| Dose (mg) | Sex | $C_{max}$ (ng/mL) | $C_0$ (ng/mL) | $AUC_{0-t}$ (hr*ng/mL) | $t^{1/2}$ (hr) | CL (mL/hr) | Vss (mL) |
|---|---|---|---|---|---|---|---|
| 0.6 | Male | 3930 | 4760 | 3310 | ND | ND | ND |
| | Female | 4950 | 5770 | 4280 | ND | ND | ND |
| | Male + Female | 4440 | 5260 | 3800 | ND | ND | ND |
| 6 | Male | 55400 | 67700 | 85800 | ND | ND | ND |
| | Female | 63700 | 78700 | 90000 | ND | ND | ND |
| | Male + Female | 60300 | 74300 | 88300 | ND | ND | ND |
| 60 | Male | 414000 | 433000 | 1120000 | 36.8 | 54.5 | 230 |
| | Female | 457000 | 460000 | 1360000 | 30.6 | 46.7 | 192 |
| | Male + Female | 436000 | 447000 | 1240000 | 33.7 | 50.6 | 211 |

ND: not determinable due to limited concentration versus time data in the terminal phase.

Exposure based on $C_{max}$ and $C_0$ generally increased in a dose-proportional manner, although the 6 mg dose level had higher than expected $C_{max}$ and $C_0$ values. Exposure based on $AUC_{0-t}$ values increased in a greater than dose-proportional manner across all dose groups, suggesting that Compound 16 clearance is reduced at higher doses (see Table 46). This also might be due, in part, to an incomplete characterization of the TK profile at the lowest dose level due to assay limitations. There also appeared to be a slower rate of decline in Compound 16 concentrations between 0.25 and 4 hours post-dose in the 6 mg dose group relative to the 0.6 mg dose group.

Additional non-compartmental TK parameters were able to be estimated for the 60 mg dose group. There were no substantial differences in the TK parameters between males and females. The overall mean $t_{1/2}$, CL, and $V_{ss}$ were 33.7 hour, 50.6 mL/hr, and 211 mL, respectively.

Metabolism (Interspecies Comparison). No metabolism studies have been conducted with Compound 16. The ICG portion of the molecule is known to be mainly excreted unchanged into the bile, and does not undergo any appreciable metabolism.

Excretion. Urine excretion has not been formally assessed. Based on biodistribution data in select normal tissues from single dose mouse tumor models and a non-GLP single dose rat study, the kidney appears to be an important organ involved in the clearance and elimination of Compound 16. This is further supported by data from the single-dose GLP rat study in which green discolored kidneys were noted in the highest dose group 2 days after injection, and the appearance of green colored urine in the single-dose GLP monkey study.

Pharmacokinetic Drug Interaction. No drug interaction studies have been conducted with Compound 16.

Compound 16 PK profiles following IV administration demonstrated a bi-exponential decline with a rapid initial phase and a longer terminal phase in all species. Based on PK data from the rat and monkey single-dose GLP studies, Compound 16 exposure based on $C_0$ or $C_{max}$ values appeared to be approximately dose proportional over the tested dose ranges. In contrast, AUC values increased in a dose-proportional or higher than dose-proportional manner, suggesting that Compound 16 clearance is reduced at higher doses. The terminal phase could be characterized in the high dose group (60 mg) in cynomolgus monkeys, allowing estimation of $t_{1/2}$, CL, and $V_{ss}$ parameters. The mean $t_{1/2}$, CL, and $V_{ss}$ values were 33.7 hours, 50.6 mL/hr, and 211 mL, respectively.

There was no obvious effect of gender on Compound 16 PK in the rat, but exposure was consistently higher in female monkeys compared to male monkeys. This finding is perhaps due to the size difference in males and females since Compound 16 was administered at fixed dose levels.

Example 23

Pharmacokinetics of Other Chlorotoxin Conjugate Compounds

This example demonstrates the pharmacokinetic (PK) profile of Compounds 1-720 following a single intravenous (IV) injection in mice, rats, dogs, and monkeys.

Materials and methods are as described in Example 22 but with Compounds 1-720.

Pilot Pharmacokinetics Study of Compounds 1-720 Following IV Administration to Male Non-Human Primates (Cynomolgus). Cynomolgus monkeys are intravenously administered a single bolus injection of Compounds 1-720 at a fixed dose level. Clinical observations are made at each time point.

In the pilot studies, pharmocokinetic (PK) profiles of Compounds 1-720 following IV administration demonstrate a bi-exponential decline with a rapid initial phase and a longer terminal phase in all species.

Following IV administration of Compounds 1-720 in the rat and monkey single-dose GLP toxicology studies, exposure based on $C_{max}$ and $C_0$ increases in an approximately dose-proportional manner across the tested ranges. $AUC_{0-t}$ values increase in a dose-proportional or higher than dose-proportional manner. These observations suggest that conjugate Compounds 1 to 720_clearance is reduced at higher doses.

Pharmacokinetics of Intravenous Administration of Compounds 1-720. In separate experiments, mice, rats, dogs and monkeys are intravenously administered as an IV bolus or IV infusion of Compounds 1-720. Serum is collected at multiple time points following administration. A fluorescence-based method is used to measure Compounds 1-720 serum concentrations. $C_{max}$, $C_0$, $t_{1/2}$ and $AUC_{0-t}$ values are obtained from the resulting data. Biodistribution is evaluated by measuring fluorescence intensity in tissue sections from the organs collected at euthanasia at time-points following intravenous administration. Distribution of Compounds 1-720 to the organs typically does not seem to have toxicological significance, with no corresponding changes in serum chemistry or histopathology.

Example 24

Pharmacokinetics of Compound 16 in Humans

This example demonstrates the pharmacokinetics of Compound 16 in human subjects with nonmelanotic skin cancer. The primary objective of the study was to evaluate the safety and tolerability of a single IV administration of Compound 16.

At the time of filing, the study was ongoing. Interim data from the first cohorts evaluated are summarized in this example.

Following a single IV administration, the maximum serum Compound 16 concentration was observed at the end of the infusion. Drug levels were detectable hours after infusion. Exposure based on $C_{max}$ and $AUC_{0-t}$ increased in a dose-dependent manner. The results indicate that pharmacokinetic data obtained using animal models is predictive of pharmacokinetics in human patients.

Overall, single IV administrations of Compound 16 were well tolerated. No significant or clear pattern of toxicities has been observed.

Example 25

Pharmacokinetics of Chlorotoxin Conjugate Compounds in Humans

This example demonstrates the pharmacokinetics of a chlorotoxin conjugate in human subjects.

Study Design:

Subjects are given intravenous (IV) bolus injections of 1 mg, 3 mg, 12 mg or 30 mg of a chlorotoxin conjugate such as Compound 16. Blood samples are collected before injection (time=0 hours) and at 30, 60, 90, 120, 180 and 240 minutes post-injection. Samples are analyzed with fluorescence-based methods and with liquid chromatography/mass spectrometry (LC/MS) method to determine pharmacokinetic profiles of chlorotoxin conjugate in humans (FIG. 27).

Initial blood serum concentration and area under the curve data are consistent with predictions from animal models (Table 47, Table 48).

TABLE 47

Initial blood serum concentration ($C_0$) and area under curve (AUC) percentile values at different time points following a 1 mg IV bolus dosing of Compound 16 into human patients.

| Parameter | Estimate |
| --- | --- |
| $C_0$ | 172.00 ng/mL |
| $AUC_{Last}$ | 85.27 hr*ng/mL |
| $AUC_{25}$ | 21.37 hr*ng/mL |

TABLE 47-continued

Initial blood serum concentration ($C_0$) and area under curve (AUC) percentile values at different time points following a 1 mg IV bolus dosing of Compound 16 into human patients.

| Parameter | Estimate |
| --- | --- |
| $AUC_{50}$ | 42.67 hr*ng/mL |
| $AUC_{75}$ | 64.07 hr*ng/mL |

TABLE 48

Times when different area under curve (AUC) percentiles are reached following a 1 mg IV bolus dosing of Compound 16 into human patients.

| Start Time (hr) | End Time (hr) | Label | Time (mm) |
| --- | --- | --- | --- |
| 0 | 0.143 | AUC25 | 8.6 ± 5.0 |
| 0 | 0.344 | AUC50 | 20.6 ± 7.8 |
| 0 | 0.690 | AUC75 | 41.4 ± 15.1 |

Example 26

Intraoperative Imaging and Tumor Identification

This example describes the tumor-binding specificity of BLZ-100 and the ratio between tumor and background binding by BLZ-100.

Intraoperative Imaging

A prototype intraoperative imaging system was utilized for patients 17 through 28 from the study described in Example 9. Its use during surgeries enabled imaging of tumor beds as well as tumors in situ and immediately following excision. The data show generally good discrimination between gross tumor and surrounding tissues. Peritumoral skin tended to have background fluorescence, while uninvolved skin had lower fluorescence. Mucosal tissues also showed background fluorescence, resulting in lack of specificity and residual non-tumor fluorescence in patient 17. Tumor bed imaging showed little or no background staining in "internal" tissues such as trachea, muscle, and fat. The intraoperative imaging showed good subjective concordance with the quantitative ex vivo image analysis conducted using the Odyssey scanner. The tumors that had overall high intensity and good tumor to normal ratios ex vivo also showed high contrast and were easy to detect intraoperatively (Table 49).

TABLE 49

Summary of intraoperative imaging observations. Imaging was not performed on patient 25 due to technical issues with the instrument. TBR was calculated when both tumor and normal tissue were imaged simultaneously.

| Patient | Tumor type | TBR (gross, ex vivo) | TBR (Intraoperative) | Delineation of tumor during surgery | Residual fluorescence in tumor bed | Clean surgical margins |
| --- | --- | --- | --- | --- | --- | --- |
| 17 | Fibrosarcoma | <1 | <1 | no | yes | yes |
| 18 | Mastocytoma | 1.5 | 1.5 | yes | no | yes |
| 19 | Soft tissue sarcoma | 5 | 19 | yes | no | yes |
| 20 | Follicular carcinoma | 2 | ND | yes | no | yes |
| 21 | Adenocarcinoma | 3 | ND | yes | no | no- invasion into vessels |
| 22 | Adenocarcinoma | 2.5 | 5 | yes, multiple lesions | no | yes |
| 23 | Squamous cell carcinoma | 5 | 8 | yes | no | yes |

TABLE 49-continued

Summary of intraoperative imaging observations. Imaging was not performed on patient 25 due to technical issues with the instrument. TBR was calculated when both tumor and normal tissue were imaged simultaneously.

| Patient | Tumor type | TBR (gross, ex vivo) | TBR (Intraoperative) | Delineation of tumor during surgery | Residual fluorescence in tumor bed | Clean surgical margins |
|---|---|---|---|---|---|---|
| 24 | Adenocarcinoma | 2 | 3 | yes | no | yes |
| 26 | Soft tissue sarcoma | 2 | 2 | yes, multiple lesions new and previously irradiated | yes | no |
| 27 | Meningioma | 2.5 | 2.5 | yes | yes | no |
| 28 | Hemangiosarcoma | <1 | <1 | no | yes | no |

ND = not determined.

Several cases are presented as examples of the clinical utility of a chlorotoxin conjugate with intraoperative imaging.

Patient 19, Soft-Tissue Sarcoma

Figure 28:
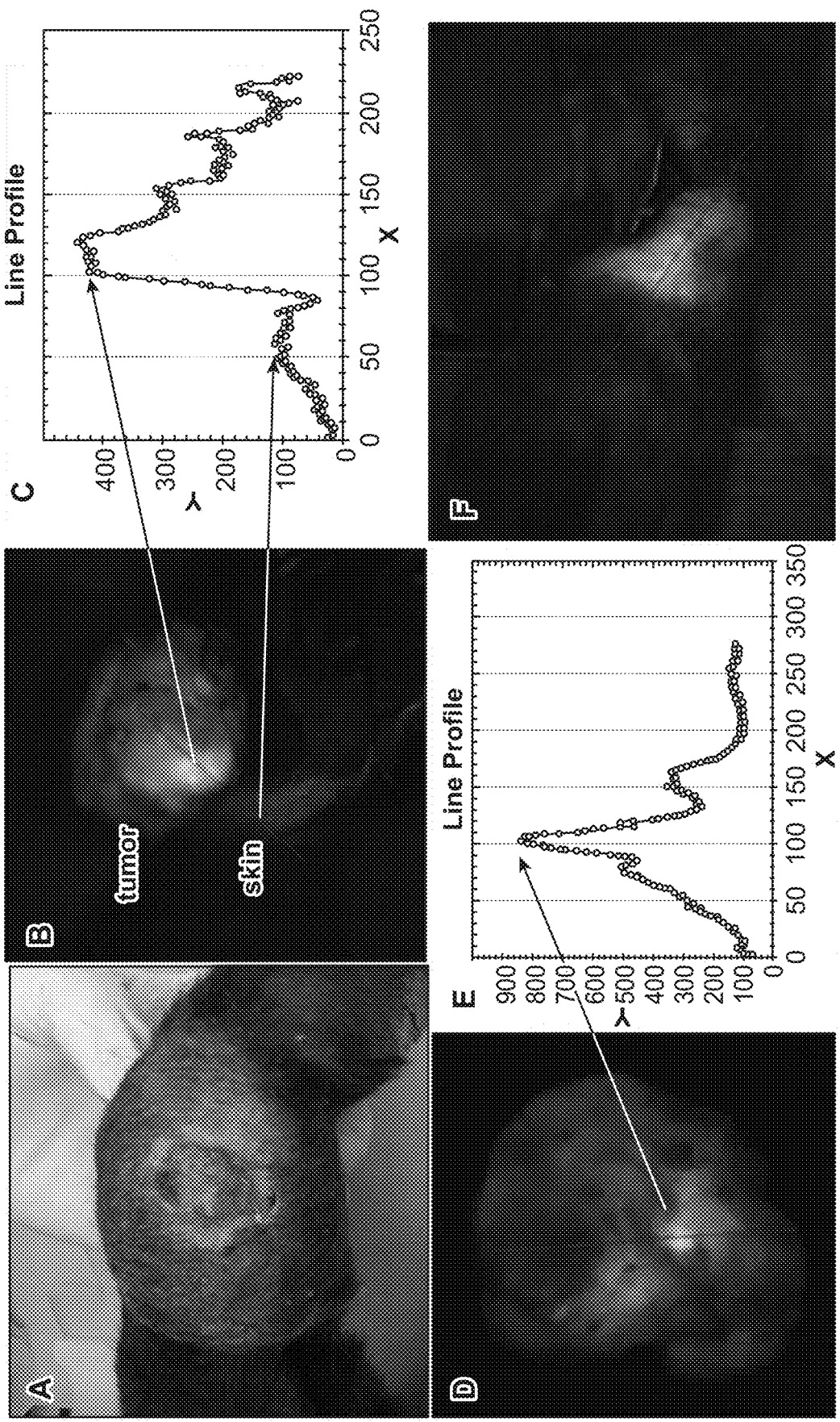
FIG. 28 shows intraoperative imaging of a soft-tissue sarcoma (patient 19). (A) White light preoperative image of gross tumor showing ulcerated and grossly swollen peritumoral skin. (B) NIR image of tumor in situ. (C) Plot of fluorescence intensity along the line drawn through the image in panel B. (D) NIR image of excised tumor. (E) Plot of fluorescence intensity along the line drawn through the image in panel D. (F) NIR image of peritumoral skin, surrounding uninvolved skin, and tumor bed. Peritumoral skin is 6-fold more intense than uninvolved skin. There is no residual fluorescence in the tumor bed. Tissues were labeled with BLZ-100.

Patient 19 had a grade II soft-tissue sarcoma on her foreleg. The tumor had been clinically evident for several months without treatment. The peritumoral skin was swollen and ulcerated (FIG. 28, panel A). Intraoperative imaging of the tumor in situ showed variable fluorescence in the tumor, some fluorescence in the swollen and ulcerated peritumoral skin, and little or no background fluorescence in other areas (FIG. 28, panels B and C). Imaging of the tumor immediately post excision showed roughly 8-fold variability of fluorescence intensity within the tumor (FIG. 28, panels D and E). The variation within the tumor is consistent with the pathology report that approximately 50% of the mass is replaced by eosinophilic debris (necrosis). Imaging of the tumor bed showed fluorescence in peritumoral skin; a sample of this skin was resected and sent for further imaging and histopathology. There was no residual fluorescence in the tumor bed or in the surrounding uninvolved skin (FIG. 28, panel F). A sample of resected peritumoral skin was sent for further imaging and histopathology, which confirmed the absence of neoplastic invasion.

Patient 22, Mammary Carcinoma

Figure 29:
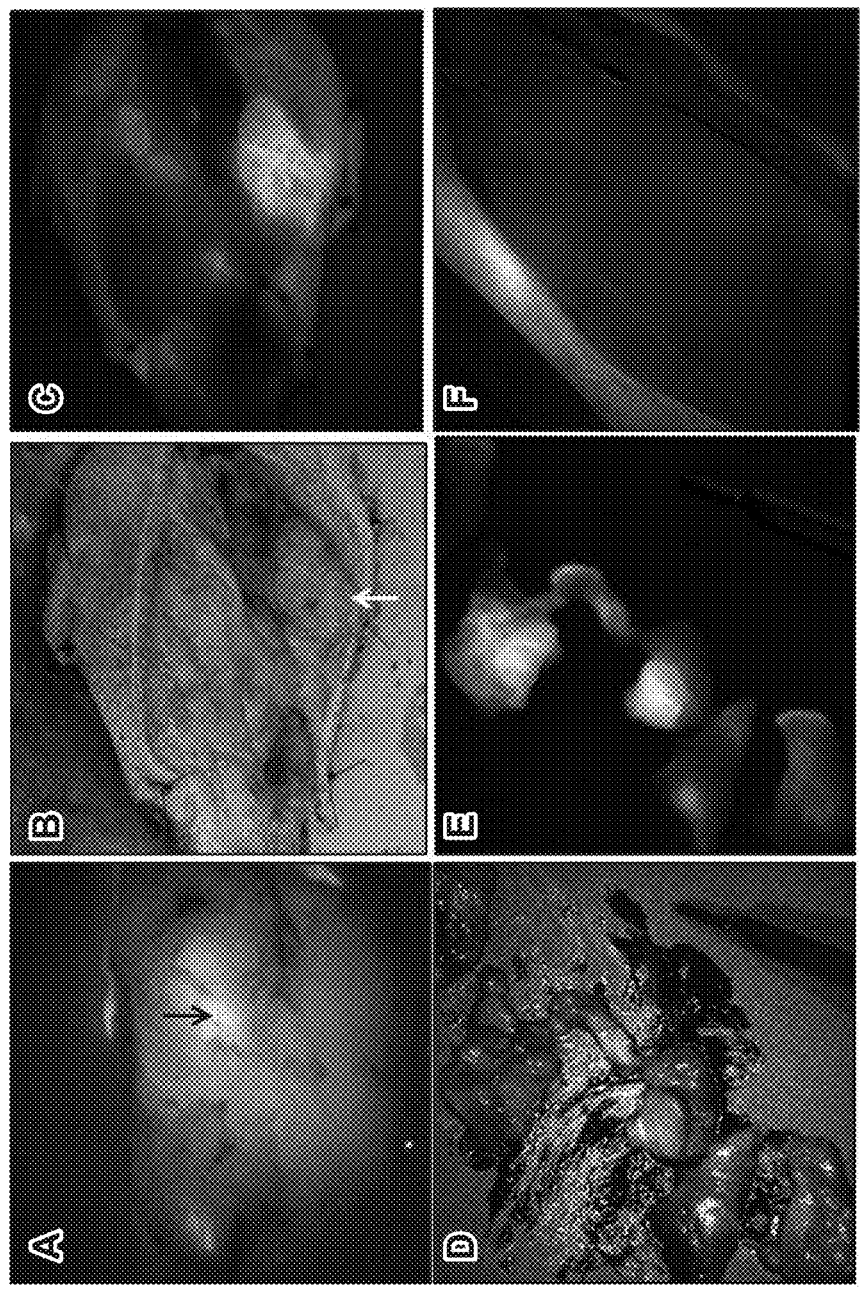
FIG. 29 shows intraoperative imaging of a mammary carcinoma (patient 22). (A) NIR image of fluorescence from the primary mass (arrow) imaged from the bottom of the resected tissue, taken immediately post-excision. This aspect had a margin of about 0.5 cm of normal tissue. Panels B (fluorescence) and C (overlay) show the primary mass from the skin side, after the skin was opened and a slice removed for further imaging. The small fluorescent patches were originally part of the primary mass, but were separated by the removal of the slice. Panels D and E show the gross appearance and fluorescence overlay of the pieces submitted for further imaging. The contrast between gross tumor and adjacent tissue is about 2.5-fold. (F) Overlay image of the tumor bed, showing lack of residual fluorescence in the muscle wall. Tissues were labeled with BLZ-100.

Patient 22 had a recurrent mammary adenocarcinoma. The tumor was removed en bloc with overlying skin and surrounding fatty tissue. Imaging of the tumor from the bottom showed that the mass is detectable through ~0.5 cm of normal fatty tissue (FIG. 29, panel A). The diffuse appearance of the fluorescence is due to tissue scattering of the emitted light. A slice for further imaging was removed from the skin side, leaving the bulk of the mass and surrounding tissue exposed. The contrast between the tumor and surrounding tissue is improved due to the absence of intervening tissue (FIG. 29, panels B and C).

The tissue pieces collected for further imaging contained gross tumor (white areas, FIG. 29, panel D) and adjacent tissue. Fluorescence imaging shows about 2.5-fold brighter fluorescence in the gross tumor areas compared with the adjacent tissue (FIG. 29, panel E). The tumor bed showed no residual fluorescence (FIG. 29, panel F). Note that the fluorescence in the skin appears brighter in panel F than in panel C; this is due to the increased sensitivity used in the survey of the tumor bed, to ensure that any residual fluorescence would be detected.

Patient 23, Cutaneous Squamous Cell Carcinoma

Figure 30:
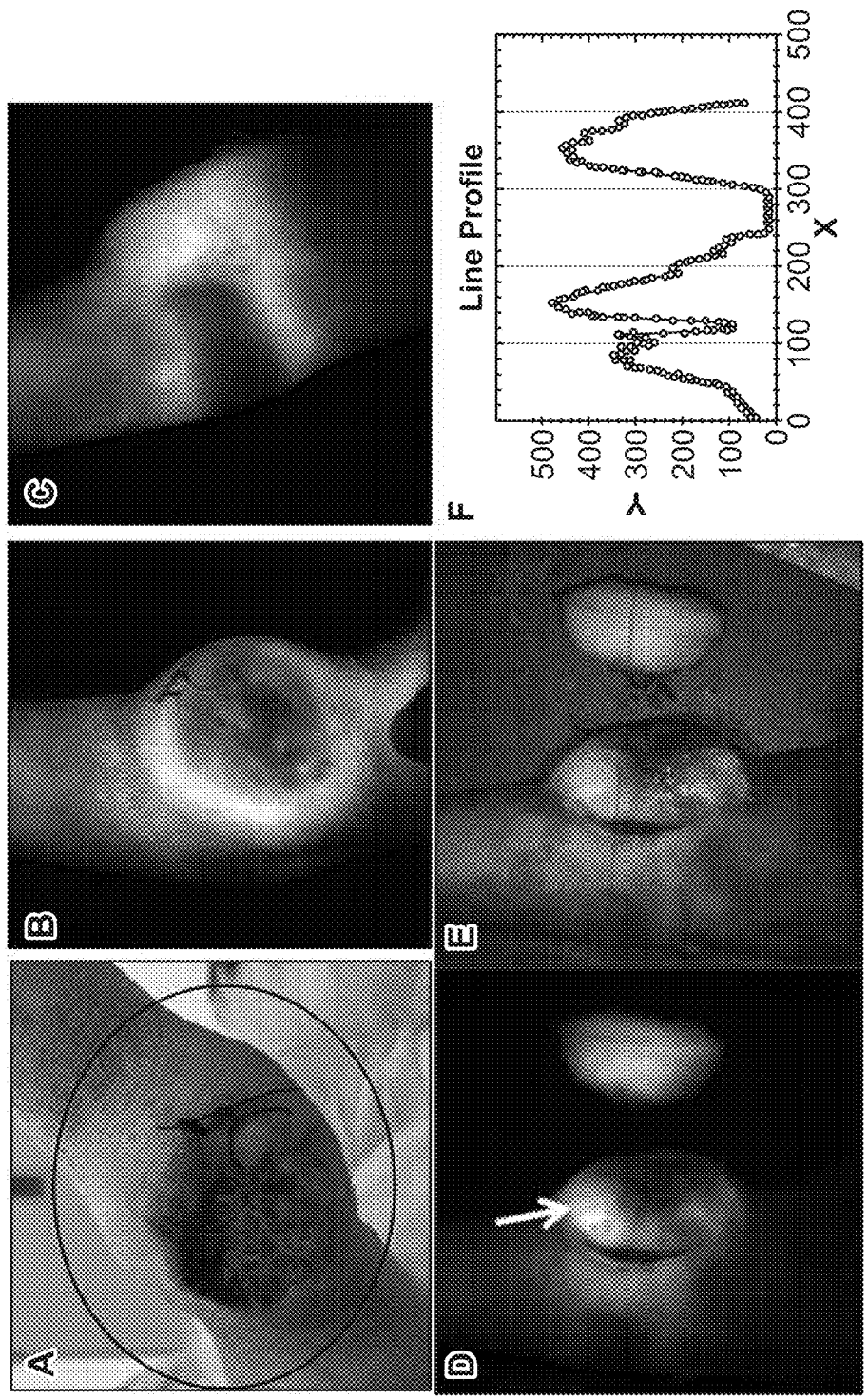
FIG. 30 shows intraoperative imaging of a cutaneous squamous cell carcinoma (patient 23). (A) White light preoperative image of tumor site, showing grossly ulcerated and swollen peritumoral skin. Panels B and C show preoperative NIR fluorescence images of the tumor from the top (B) and side (C). NIR fluorescence (D) and overlay (E) are shown following removal of the tail. The mass at right is a section of central tumor removed for further analysis. The skin is retracted, and the remaining gross tumor (arrow) is revealed. Fluorescence intensity is similar in the central tumor and remaining gross tumor, while peritumoral skin has somewhat lower fluorescence intensity (F). Tissues were labeled with BLZ-100.

Patient 23 had a cutaneous squamous cell carcinoma of the tail. The lesion had penetrated the skin, which was grossly swollen and ulcerated (FIG. 30, panel A). The lesion was covered by a serocellular crust. Preoperative fluorescence imaging showed very little fluorescence penetrating the serocellular crust, while the peritumoral skin showed relatively bright staining (FIG. 30, panel B). Two "fingers" of fluorescence were noted, which extended to the opposite side of the tail (FIG. 30, panel C).

Following removal of the tail, tissues were imaged and sections were removed for further imaging. A section of central tumor (FIG. 30, panels D and E, at right) showed relatively intense fluorescence. The remaining central tumor, viewed from the side rather than through the serocellular crust, showed fluorescence intensity similar to that of the central tumor. The peritumoral skin was less intense than the tumor itself (FIG. 30, panel F), but was about 3-fold more intense than uninvolved skin. Samples of skin from the fluorescent areas on the opposite side of the tumor were submitted for histopathology, and they did not contain tumor.

Patient 20, Thyroid Carcinoma

Figure 31:
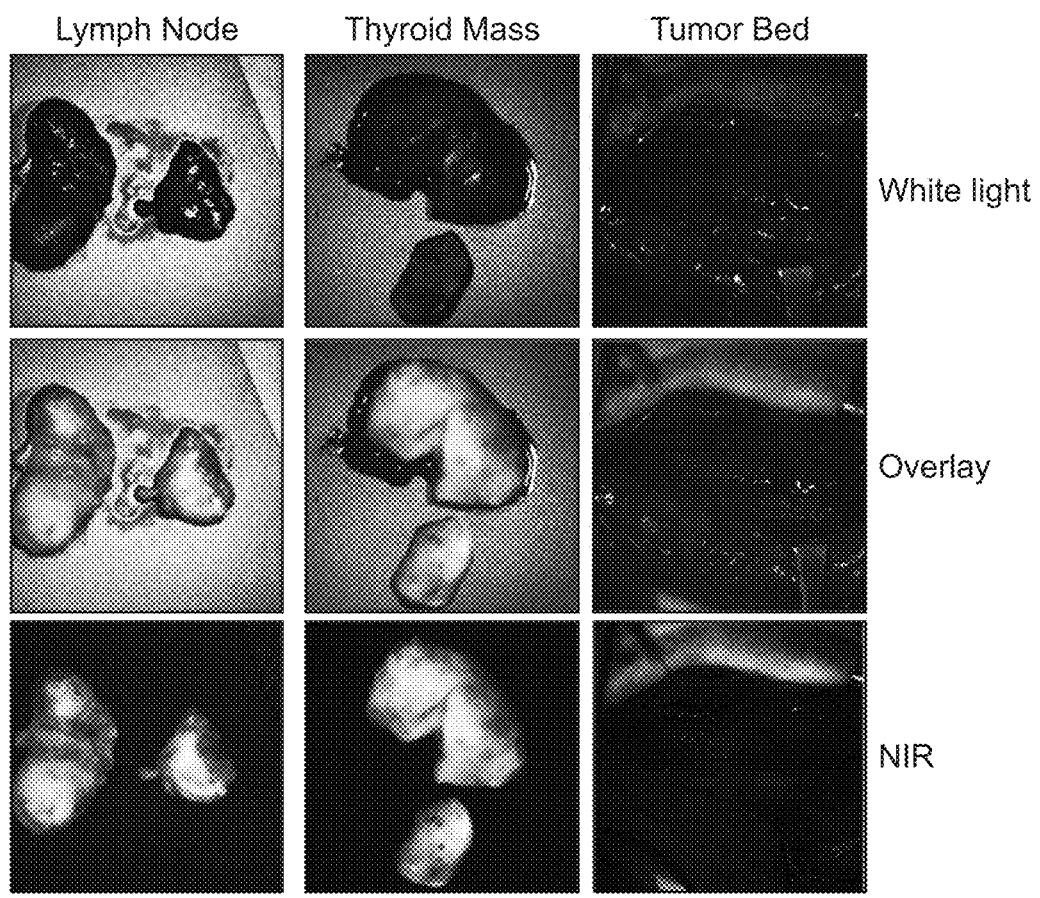
FIG. 31 shows intraoperative imaging of a thyroid carcinoma (patient 20). (Top) White light images of excised lymph node, thyroid mass, and tumor bed. (Middle) NIR fluorescence signal overlaid on white light images. (Bottom) Monochrome NIR images. The lymph node and thyroid mass each have a section removed for further analysis, shown side-by-side with the bulk tissue.

Patient 20 had a thyroid carcinoma. The entire thyroid gland was removed, along with an enlarged lymph node. Intraoperative imaging of the thyroid showed most of the gland was fluorescent, with about 2-fold variation in signal intensity throughout (FIG. 31). The lymph node had regions of fluorescence that were comparable to the primary tumor. The tumor bed had no residual fluorescence. Additionally, no significant non-specific background fluorescence was observed in the internal structures including the trachea, nerves, and arteries. Histopathology showed that the thyroid was 95% effaced by the tumor, which had large areas of blood filled spaces and necrosis. These may account for the variability in staining seen in the primary tumor. The lymph node was confirmed to contain metastatic disease.

Example 27

Specificity and Tumor to Background Ratio of Other Chlorotoxin Conjugate Compounds This example describes the tumor-binding specificity of Compounds 1-720 and the ratio between tumor and background binding by Compounds 1-720.

Intraoperative Imaging

Methods and materials used are as described in Example 26, but with Compounds 1-720. A prototype intraoperative imaging system is utilized. Its use during surgeries enables imaging of tumor beds as well as tumors in situ and immediately following excision. The data show generally good discrimination between gross tumor and surrounding tissues. Peritumoral skin tends to have background fluorescence, while uninvolved skin has lower fluorescence. Tumor bed imaging shows little or no background staining in "internal" tissues such as trachea, muscle, and fat. The intraoperative imaging shows good subjective concordance with the quantitative ex vivo image analysis conducted using the Odyssey scanner. The tumors that have overall high intensity and good tumor to normal ratios ex vivo also show high contrast and are easy to detect intraoperatively.

Example 28

Histopathologic Scoring, Sensitivity and Specificity

This example describes the evaluation of tumor and adjacent tissues at the cellular level in order to assess sensitivity and specificity of a chlorotoxin conjugate, such as BLZ-100 for cancer cells.

Evaluation of canine tumor and adjacent tissues at the cellular level was performed in order to assess sensitivity and specificity of BLZ-100 for cancer cells. For this analysis, two cutaneous squamous cell carcinomas, three mammary cancers, and four subcutaneous soft tissue sarcomas were included. Sensitivity and specificity was calculated using a grid analysis on 30 micron frozen sections. An overlay of each fluorescence image with the corresponding H&E stained image that was scored as tumor or normal by a histopathologist was analyzed. This analysis was performed separately for each case.

The data were grouped by individual section and plotted for each patient. The subcutaneous soft tissue sarcomas showed highly specific tumor fluorescence. A logistic regression analysis was used to determine a reasonable threshold intensity for detecting tumor in the subcutaneous soft-tissue sarcomas. Non-skin tissues were used to compute sensitivity and specificity, with a threshold intensity of 30,000 used as a cutoff value. Grid squares were called tumor or no tumor based on fluorescence intensity and based on pathologist call. Concordant and discordant calls are used to calculate sensitivity and specificity. Sensitivity (95%) and specificity (85%) were very good using a threshold grid square fluorescence of 30,000. Peritumoral skin in patient 19 was above this threshold in all grid squares; as discussed in Example 26, this patient had an ulcerated tumor and grossly edematous skin immediately adjacent to the mass. The elevated signal in this patient's skin sample accounted for all above-threshold data points in this analysis.

The cutaneous squamous cell carcinomas had fluorescence signal coming both from the tumor and from the underlying dermis. In most cases, the signal was brighter in the underlying dermis, leading to the "inverted" tumor vs. normal intensity. Although histologic specificity in these tumors is low, truly uninvolved skin seen during intraoperative imaging in patient 23 and during ex vivo imaging in patient 14 was not fluorescent. Analysis of the mammary tumors shows that, like skin, mammary tissue adjacent to tumor takes up BLZ-100. In both tumor types, gross tumors had higher fluorescence than uninvolved tissue.

For this analysis, two cutaneous squamous cell carcinomas, three mammary cancers, and three subcutaneous soft-tissue sarcomas were included. Tissues were sectioned on a cryostat, and 30 micron sections were imaged on the Odyssey scanner. These sections or serial sections were stained with H&E and read by an expert histopathologist who was blinded to the fluorescence data. A grid was overlaid on the fluorescence image, and total fluorescence in each grid square was measured using Image Studio (Li-Cor) software provided with the Odyssey scanner. Overlay of the fluorescence image with the scored H&E image enabled calling of tumor vs. non-tumor for each grid square.

For each tumor, grid analysis was done on sections from different areas of tumor and adjacent non-tumor tissue, as well as samples of uninvolved tissue when available. As discussed above, background staining in the swollen, ulcerated skin in patient 19 caused suspicion of tumor infiltration during the surgery. The fluorescence analysis in sections of this skin would lead to the same conclusion. Note that the uninvolved skin samples from patients 12 and 13 are well below the threshold for being incorrectly identified as tumor tissue.

Example 29

Histopathologic Scoring, Sensitivity and Specificity of Chlorotoxin Conjugate Compounds This example describes the evaluation of tumor and adjacent tissues at the cellular level in order to assess sensitivity and specificity of a chlorotoxin conjugate, such as Compound 16 for cancer cells.

Figure 32:
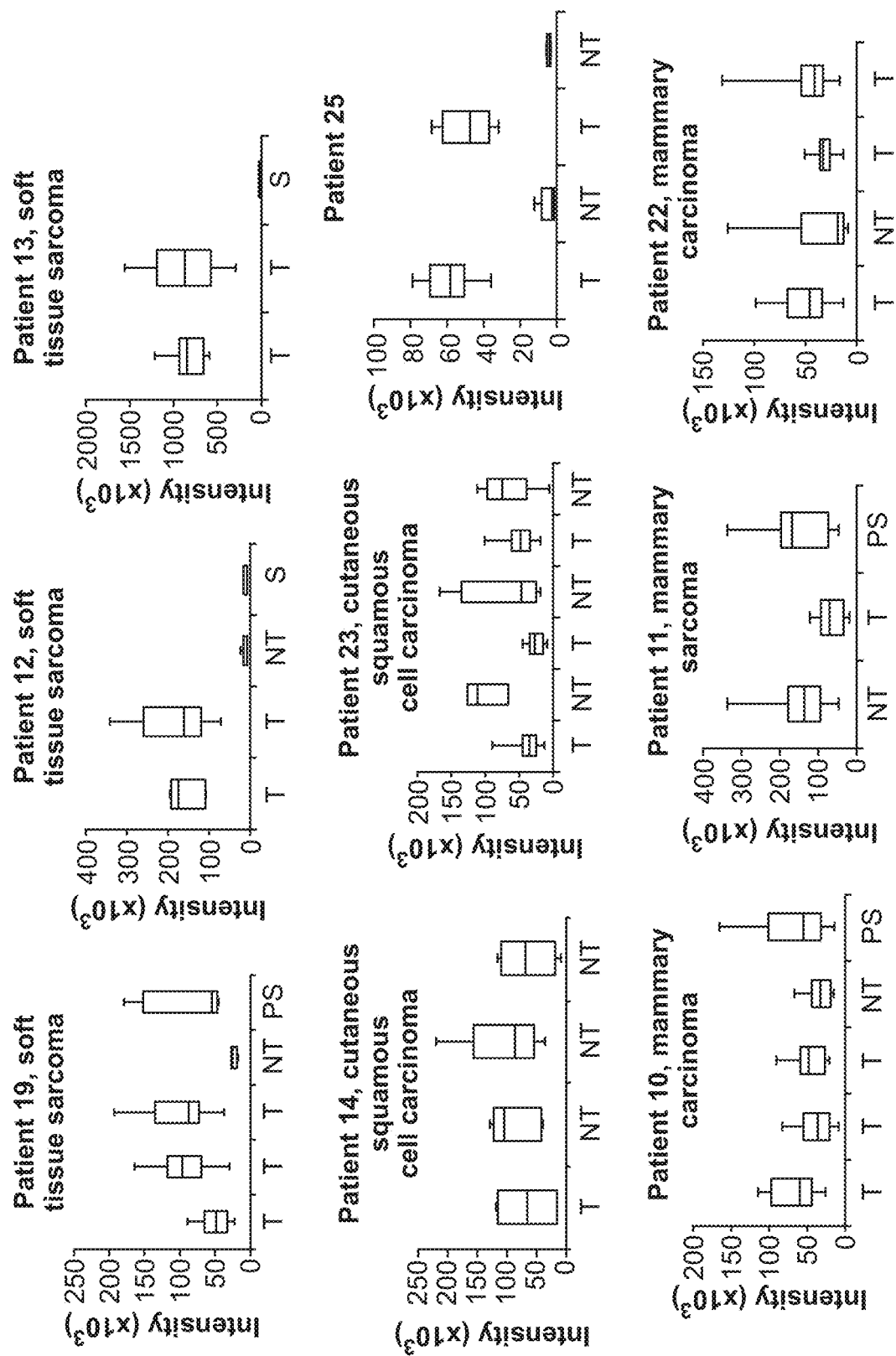
FIG. 32 shows a box & whiskers plots of fluorescence intensity in grid squares for each tissue section analyzed. T, tumor. NT, adjacent non-tumor tissue. PS, peritumoral skin. S, uninvolved skin. For the cutaneous tumors, the NT consisted of underlying dermis, subcutaneous fat, and adjacent dermis/epidermis. Tissues were labeled with a chlorotoxin conjugate compound.

Materials and methods used were as described in Example 28. FIG. 32 shows box & whiskers plots of fluorescence intensity in grid squares from multiple patients and for each tissue section analyzed (T, tumor. NT, adjacent non-tumor tissue. PS, peritumoral skin. S, uninvolved skin). Sensitivity (95%) and specificity (85%) were very good using a threshold of 30,000 (arbitrary units). Peritumoral skin in patient 19 was above this threshold in all grid squares. This patient had an ulcerated tumor and grossly edematous skin immediately adjacent to the mass. The elevated signal in this patient's skin sample accounted for all above-threshold data points in this analysis.

Grid squares were called tumor or no tumor based on fluorescence intensity and based on pathologist call. Concordant and discordant calls are used to calculate sensitivity and specificity. The results are shown in Table 50.

TABLE 50

Sensitivity and specificity analysis for subcutaneous soft-tissue sarcoma samples.

|  | Tumor (pathologist) | No Tumor (pathologist) | Total |
|---|---|---|---|
| Tumor (intensity) | 111 | 0 | 111 |
| No Tumor (intensity) | 7 | 11 | 18 |
| Total | 118 | 11 | 129 |

Kappa coefficient (95% CI): 0.730 (0.543, 0.917);
Sensitivity (95% CI): 94.1% (88.2%, 97.6%);
Specificity (95% CI): 100.0% (71.5%, 100.0%).

Example 30

Histopathologic Scoring, Sensitivity and Specificity of Other Chlorotoxin Conjugate Compounds This example describes the evaluation of tumor and adjacent tissues at the cellular level in order to assess sensitivity and specificity of a chlorotoxin conjugate, such as Compounds 1-720 for cancer cells.

Evaluation of canine tumor and adjacent tissues at the cellular level is performed in order to assess sensitivity and specificity of Compounds 1-720 for cancer cells. Sensitivity and specificity are calculated using a grid analysis on 30 micron frozen sections. An overlay of each fluorescence image with the corresponding H&E stained image that was scored as tumor or normal by a histopathologist is analyzed. This analysis is performed separately for each case. Cutaneous squamous cell carcinomas, mammary cancers, and subcutaneous soft-tissue sarcomas are evaluated. Tumor tissue and tissue adjacent to tumors has higher mean fluorescence than does normal tissue.

Example 31

Labeling of Additional Types of Tumors

This example describes the use of BLZ-100 for the labeling of other miscellaneous tumor types not described in the preceding examples. Besides the above-described tumor types, there were several tumor types for which the number of patients was insufficient to conduct meaningful sensitivity and specificity analysis. These include mast cell tumors (N=1 at effective dose), lung cancer (N=1), and meningioma (N=1). There were two thyroid carcinomas in which signal in 30 micron sections was too low to permit the analysis. The oral tumors were determined to be non-specific on gross imaging.

Lung cancer is of potential interest clinically. The results of gross imaging in the canine lung cancer suggest specific tumor uptake, with 3:1 TBR compared with adjacent lung or with uninvolved skin. There was a small suspected metastasis seen in the adjacent lung tissue. On histopathologic analysis, the signal intensity was low but measurable, and was specific for tumor in the primary mass. The suspected metastasis could not be confirmed due to frozen section artifact.

Brain tumors are of very high interest for clinical and commercial development of a chlorotoxin conjugate. There was one brain tumor case enrolled in the study, a meningioma. Meningiomas are extra-axial tumors with typically low histologic grade in dogs as well as in humans. Intraoperative imaging showed signal in the chlorotoxin conjugate-labeled tumor with a 2.5-fold tumor to background (normal brain) ratio. The surgical approach was through the sinus, so nasal mucosa was present in the image. The mucosal tissues are a known source of background, and in this case provided a positive control for fluorescence intensity. Tumor was removed in fragments; pieces to be analyzed were embedded in OCT and snap-frozen. Imaging of 30 micron sections showed low but detectable signal. The optimal dose for CNS tumors arising within the blood-brain barrier will have to be determined with additional subjects, including cases with malignant tumors such as glioma. However, this case did provide an opportunity for imaging of normal brain tissue, and it demonstrated that a low-grade brain tumor can be successfully imaged. This is significant, since complete resection in low-grade tumors can be curative.

Example 32

Labeling of Additional Types of Tumors Using Chlorotoxin Conjugate Compounds

This example describes the use of Compound 16 for the labeling of other tumor types.

Figure 33:
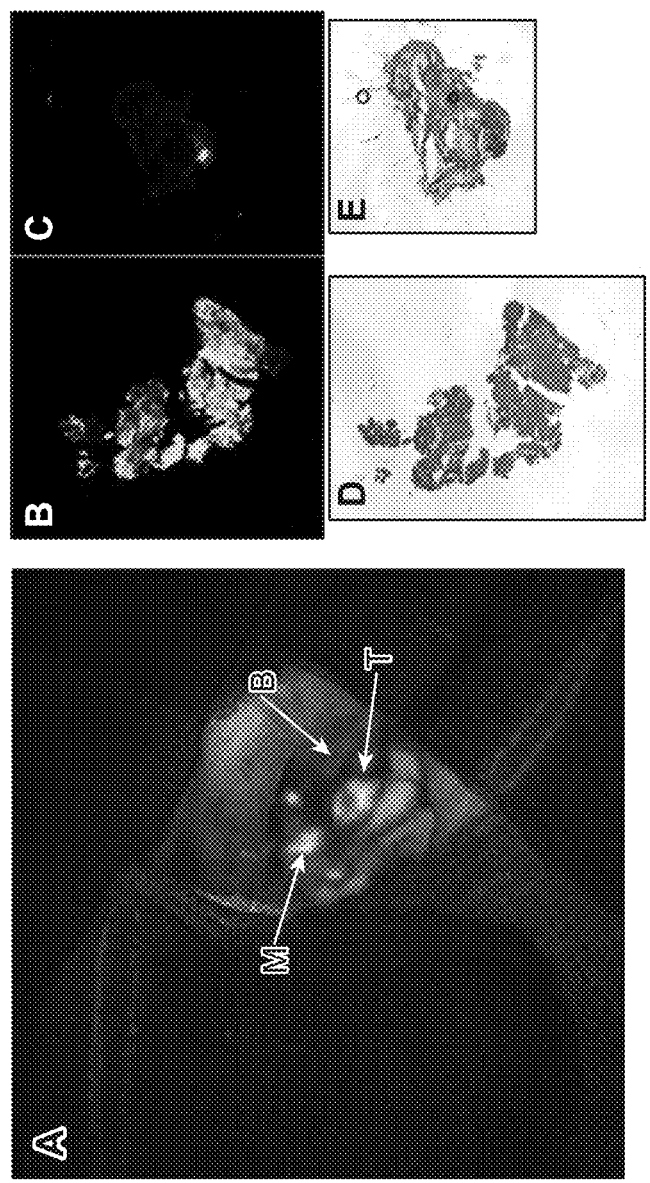
FIG. 33 shows imaging of a brain tumor labeled with BLZ-100. (A) NIR fluorescence image of tumor in situ. T, tumor. M, nasal mucosa. B, normal brain. Panels B and C show fluorescence images of 30 micron sections from two of the tumor pieces. Panels D and E show H&E stains of the sections in B and C, respectively.

Intraoperative imaging of a canine meningioma showed signal in the Compound 16-labeled tumor (FIG. 33, panel A), with a 2.5-fold tumor to background (normal brain) ratio. The surgical approach was through the sinus, so nasal mucosa was present in the image. The mucosal tissues are a known source of background, and in this case provided a positive control for fluorescence intensity. Tumor was removed in fragments; pieces to be analyzed were embedded in OCT and snap-frozen. Imaging of 30 micron sections showed low but detectable signal (FIG. 33, panels B and C). H&E stained sections are shown for comparison (FIG. 33, panels D and E). This case demonstrated that a low-grade brain tumor can be successfully imaged.

Example 33

Labeling of Additional Types of Tumors Using Other Chlorotoxin Conjugate Compounds This example describes the use of Compounds 1-720 for the labeling of miscellaneous tumor types, such as mast cell tumors, lung cancer, meningioma, thyroid carcinomas, and oral tumors.

Intraoperative tumor imaging shows signals emitted by Compounds 1-720. The tumors are removed in fragments; pieces to be analyzed are embedded in OCT and snap-frozen. Imaging of 30 micron sections shows low but detectable signal. H&E stained sections are used for comparison. Tumors are successfully identified using Compounds 1-720 and optimal doses are determined.

Example 34

Manufacture of Peptides

The peptide sequence was reverse-translated into DNA, synthesized, and cloned in-frame with siderocalin using standard molecular biology techniques. (M. R. Green, Joseph Sambrook. Molecular Cloning. 2012 Cold Spring Harbor Press.). The resulting construct was packaged into a lentivirus, transfected into HEK293 cells, expanded, isolated by immobilized metal affinity chromatography (IMAC), cleaved with tobacco etch virus protease, and purified to homogeneity by reverse-phase chromatography. Following purification, each peptide was lyophilized and stored frozen.

Example 35

Radiolabeling of Peptide

This example describes radiolabeling of peptides with standard techniques. See J Biol Chem. 254(11):4359-65 (1979). The sequences were engineered to have the amino acids, "G" and "S" at the N terminus. See *Methods in Enzymology* V91:1983 p. 570 and *Journal of Biological Chemistry* 254(11):1979 p. 4359. An excess of formaldehyde was used to ensure complete methylation (dimethylation of every free amine). The labeled peptides were isolated via solid-phase extraction on Strata-X columns (Phenomenex 8B-S100-AAK), rinsed with water with 5% methanol, and recovered in methanol with 2% formic acid. Solvent was subsequently removed in a blowdown evaporator with gentle heat and a stream of nitrogen gas.

Example 36

Peptide Detectable Agent Conjugates

This example describes the dye labeling of peptides. A peptide of the disclosure is expressed recombinantly or chemically synthesized, and then the N-terminus of the peptide is conjugated to a detectable agent via an NHS ester using DCC or EDC to produce a peptide-detectable agent conjugate. The detectable agent is the fluorophore dye is a cyanine dye, such as Cy5.5 or an Alexa fluorophore, such as Alexa647.

The peptide detectable agent conjugates are administered to a subject. The subject can be a human or a non-human animal. After administration, the peptide detectable agent conjugates home to cartilage. The subject, or a biopsy from the subject, can be imaged to visualize localization of the peptide detectable agent conjugates to cartilage. In some aspects, visualization of the peptide detectable agent conjugates in cartilage after administration results in diagnosis of arthritis, cartilage damage, or any cartilage disorder.

Example 37

Method to Determine Improved Peptide Variants

This example shows a method for determining ways to improve peptide variants by comparing and analyzing the primary sequences and tertiary structures of scaffold peptides. FIG. 38A-FIG. 38C show sequences of SEQ ID NO: 1025 aligned with SEQ ID NO: 800, SEQ ID NO: 1025 aligned with SEQ ID NO: 1026, and SEQ ID NO: 1025 aligned with SEQ ID NO: 967. The sequence alignment of the two scaffolds was used to identify conserved positively charged residues (shown in boxes) that may be important for cartilage homing. A peptide of SEQ ID NO: 967 homes to cartilage and other peptides with positively charged residues in similar positions, or cysteines in similar positions, or other residues that are in similar positions are also predicted to home to cartilage.

Figure 34:
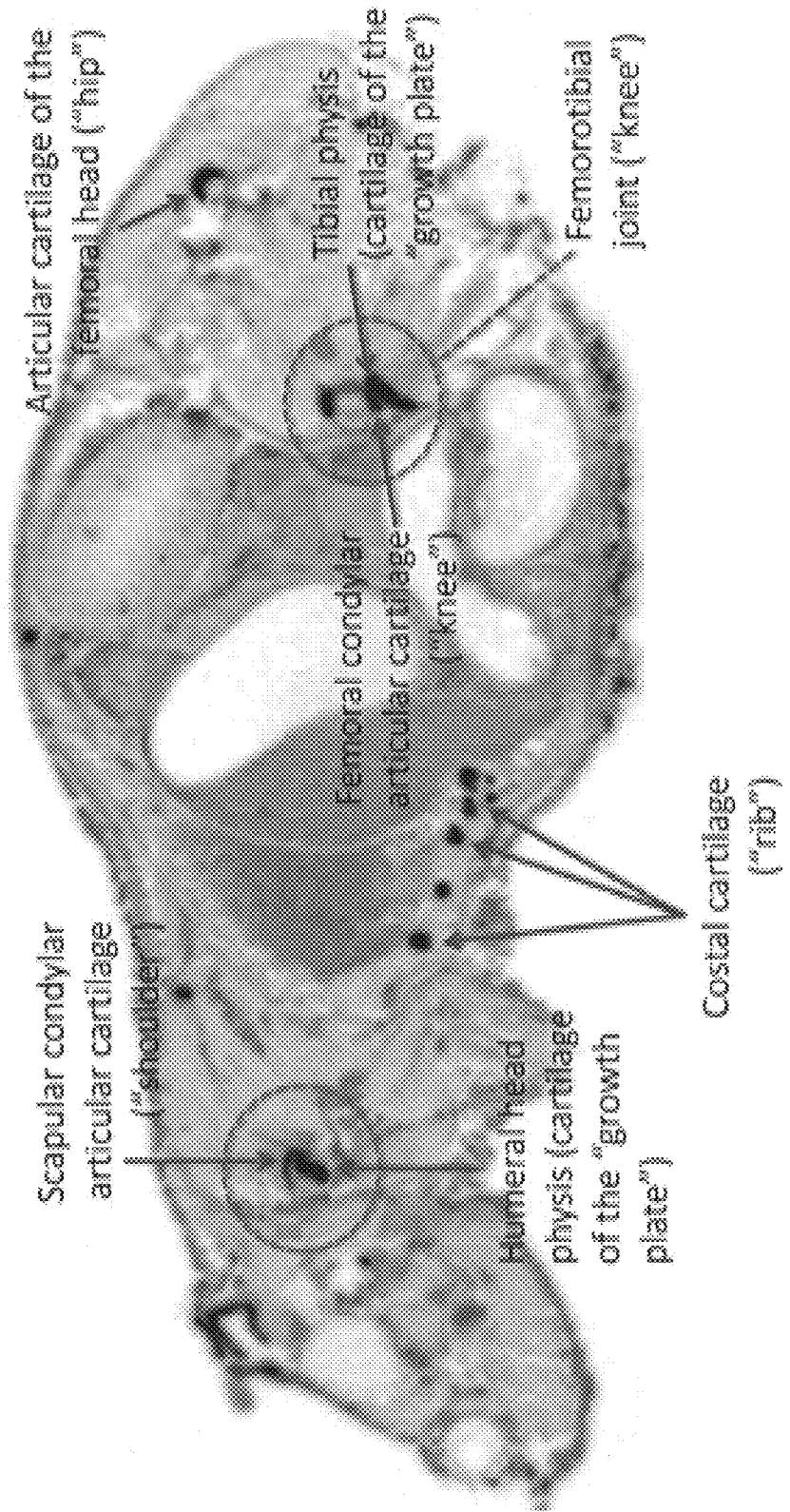
FIG. 34 illustrates the identification of the $^{14}$C signal in the joint and other cartilage of an animal treated with the peptide of SEQ ID NO: 511.
Figure 35:
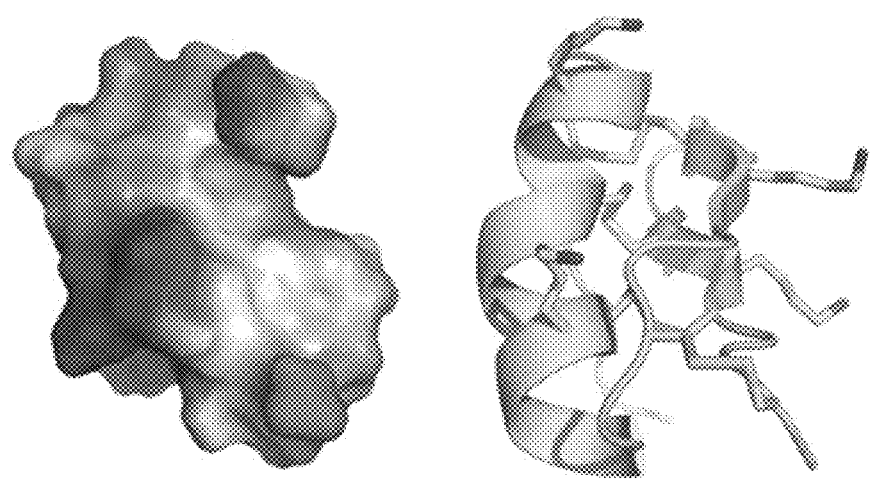
FIG. 35 illustrates a three-dimensional structure and a line structure of a peptide of SEQ ID NO: 515.
Figure 45:
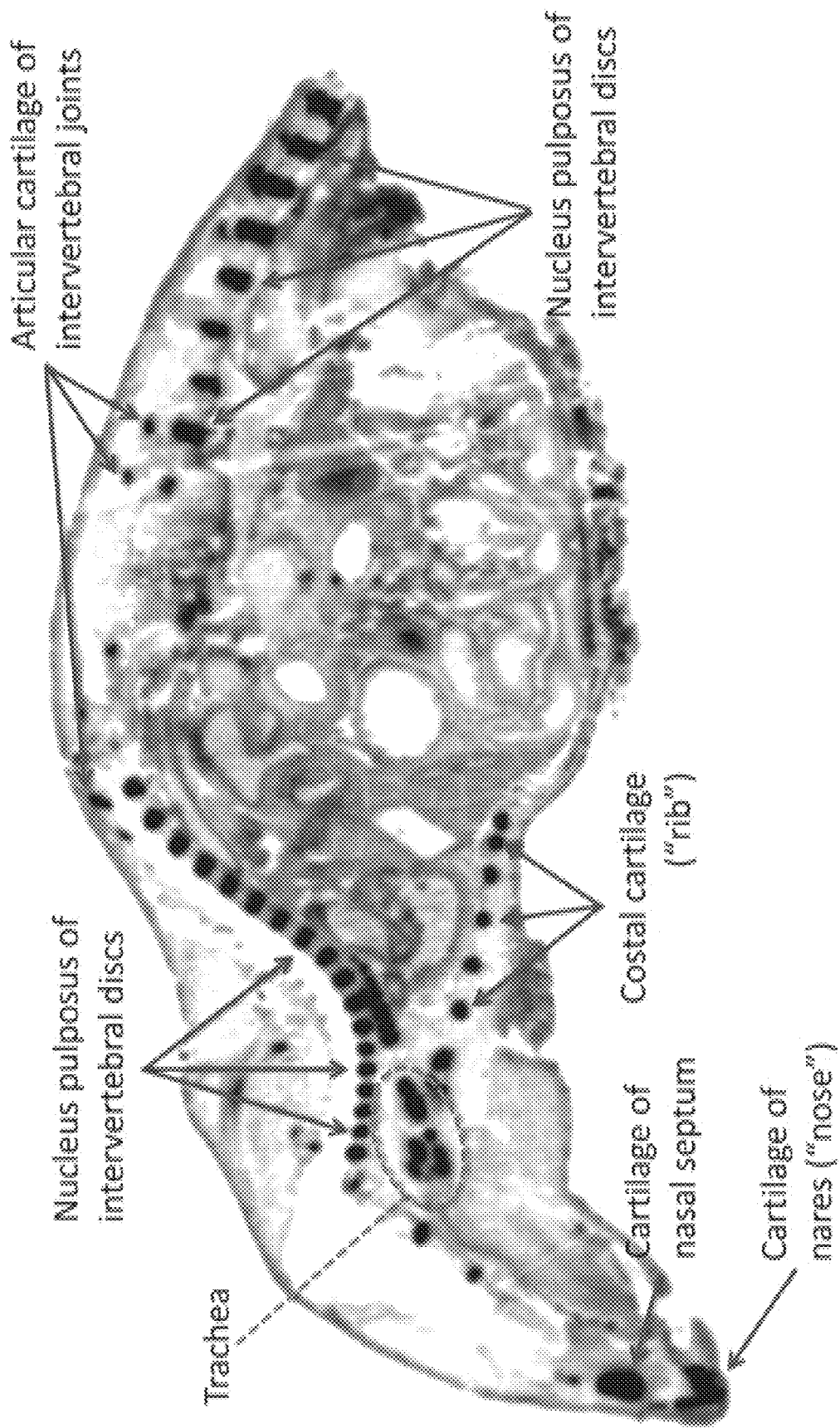
FIG. 45 illustrates the identification of locations the $^{14}$C signal in the nasal, spinal, tracheal, and other cartilage of an animal treated with the peptide of SEQ ID NO: 511.

FIG. 39 shows sequences of SEQ ID NO: 804 aligned with SEQ ID NO: 968. The sequence alignment of the two scaffolds was used to identify the basic/aromatic dyad that may be involved in the interaction with the Kv ion channel (K27 and Y36 of SEQ ID NO: 968). The mutation of K27 to alanine, arginine, or glutamic acid destroyed activity against the squid Kv1A ion channel. K27 and Y36 may be desirable to maintain or add to a cartilage homing peptide of this disclosure to maintain or improve homing, to maintain or improve residence time in cartilage, or to maintain or improve modulation of an ion channel such as Kv. In contrast, K27 and Y36 may be desirable to mutate out of a cartilage homing peptide to reduce interaction with an ion channel such as Kv. Disruption of either the basic or aromatic residue eliminates ion channel activity. In another example, D amino acids are expected to reduce or eliminate binding.

Example 38

Sequence Alignment to pFam00451:Toxin_2 Family to Identify Cartilage Homing Peptides This example describes a method for identifying new cartilage homing peptides by sequence alignment to the pFam00451:toxin_2 structural class family. The pFam00451:toxin_2 structural class is a family of peptides related by similarities in sequence identity. FIG. 40 illustrates alignment of peptides within the pfam00451:toxin_2 structural class family of SEQ ID NO: 978-SEQ ID NO: 1024. Boxed and bolded residues indicate relative conservation of sequence while non-boxed and non-bolded residues indicate areas of higher sequence variability. SEQ ID NO: 978 was identified as a cartilage homing candidate peptide based on its structural similarities with the pFam00451:toxin_structural class family. FIG. 41 illustrates the sequence alignment of a peptide of SEQ ID NO: 978 from the pfam00451:toxin 2 structural class family with the sequence of SEQ ID NO: 511. Asterisks indicate positions with a single, fully conserved residue, a colon indicates conservation between groups of strongly similar properties (scoring >0.5 in the Gonnet point accepted mutation (PAM) 250 matrix), and a period indicates conservation between groups of weakly similar properties (scoring ≤0.5 in the Gonnet PAM 250 matrix). SEQ ID NO: 592 was also identified as a cartilage homing candidate based on its structural similarities with the pfam00451:toxin_2 structural class family of peptides.

The pFam00451:toxin_2 structural class family is used as a scaffold to identify variant peptides that have cartilage homing properties. Any member of the pFam00451:toxin_2 structural class family is used to predict new cartilage homing peptides based on homology, preserved residues, or a preserved cysteine residue.

Example 39

Dosing of Peptide with Kidney Ligation

This example describes a dosing scheme for administering peptides to mice in conjunction with kidney ligation. Different dosages of the peptides were administered to Female Harlan athymic nude mice, weighing 20 g-25 g, via tail vein injection (n=2 mice per peptide). The sequence of thirteen cartilage homing peptides of SEQ ID NO: 508-SEQ ID NO: 520 are shown in TABLE 51. The experiment was done in duplicates. The kidneys were ligated to prevent renal filtration of the peptides. Each peptide was radiolabeled by methylating lysines and the N-terminus, so the actual binding agent may contain methyl or dimethyl lysine(s) and a methylated or dimethylated amino terminus.

A target dosage of 50-100 nmol of each peptide carrying 10-25 uCi of $^{14}C$ was administered to Female Harlan athymic nude mice while anesthetized. Each peptide was allowed to freely circulate within the animal before the animals were euthanized and sectioned.

Example 40

Peptide Homing with Kidney Ligation

This example illustrates peptide homing to cartilage of mice with kidneys that were ligated prior to peptide administration. At the end of the dosing period in EXAMPLE 39, mice were frozen in a hexane/dry ice bath and then frozen in a block of carboxymethylcellulose. Whole animal sagittal slices were prepared that resulted in thin frozen sections being available for imaging. Thin, frozen sections of animal including imaging of tissues such as brain, tumor, liver, kidney, lung, heart, spleen, pancreas, muscle, adipose, gall bladder, upper gastrointestinal tract, lower gastrointestinal tract, bone, bone marrow, reproductive track, eye, cartilage, stomach, skin, spinal cord, bladder, salivary gland, and other types of tissues were obtained with a microtome, allowed to desiccate in a freezer, and exposed to phosphoimager plates for about ten days.

These plates were developed, and the signal (densitometry) from each organ was normalized to the signal found in the heart blood of each animal. A signal in tissue darker than the signal expected from blood in that tissue indicates peptide accumulation in a region, tissue, structure or cell. For instance, the cartilage is avascular and contains minute amounts of blood. A ratio of at least 170% signal in the cartilage versus heart ventricle was chosen as a reference level for significant targeting to cartilage, which also correlated with clear accumulation in cartilaginous tissues in the images of the slices. FIG. 34 identifies the locations of the SEQ ID NO: 511 peptide distribution in joint and other cartilage. FIG. 45 identifies the locations of the SEQ ID NO: 511 peptide distribution in nasal, spinal, tracheal, and other cartilage, including to hyaline cartilage such as articular cartilage and physeal cartilage, as well as fibrocartilage.

Figure 42:
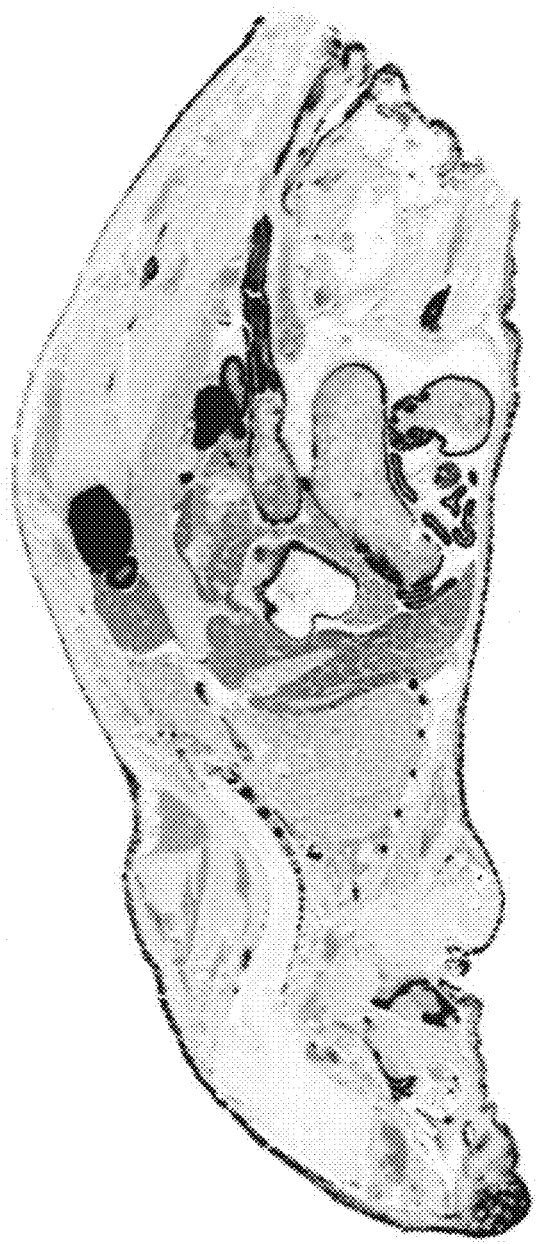
FIG. 42 illustrates the $^{14}$C signal in the cartilage of an animal with intact kidneys 24 hours after treatment with a peptide of SEQ ID NO: 511.

Additionally, the peptide can be retained in cartilage for hours after treatment. The SEQ ID NO: 511 peptide was radiolabeled as in EXAMPLE 39 and 100 nmol of peptide was injected into a mouse with intact kidneys. FIG. 42 illustrates the retention of and the tissue distribution in the cartilage of a peptide of SEQ ID NO: 511, 24 hours after administration.

Example 41

Dosing of Peptide without Kidney Ligation

This example describes a dosing scheme for administering peptides to mice without kidney ligation. The peptide administered had the sequence of SEQ ID NO: 511 as shown in TABLE 51. The peptide was radiolabeled by methylating lysines and the N-terminus, so the actual binding agent may contain methyl or dimethyl lysine(s) and a methylated or dimethylated amino terminus.

A target dosage of 100 nmol of each peptide carrying 10-25 µCi of $^{14}$C was administered to Female Harlan athymic nude mice by a tail vein injection. Each peptide was allowed to freely circulate within the animal for either 4 hours or 24 hours before the animals were euthanized and sectioned.

Example 42

Peptide Homing with Intact Kidneys

This example illustrates peptide homing to cartilage in animals with intact kidneys. At the end of the 4 hour or 24 hour dosing periods in EXAMPLE 41, mice were frozen in a hexane/dry ice bath and then frozen in a block of carboxymethylcellulose. Whole animal sagittal slices were prepared that resulted in thin frozen sections being available for imaging. Thin, frozen sections of animal including imaging of tissues such as brain, tumor, liver, kidney, lung, heart, spleen, pancreas, muscle, adipose, gall bladder, upper gastrointestinal track, lower gastrointestinal track, bone, bone marrow, reproductive track, eye, cartilage, stomach, skin, spinal cord, bladder, salivary gland, and other types of tissues were obtained with a microtome, allowed to desiccate in a freezer, and exposed to phosphoimager plates for about ten days.

These plates were developed. A signal in tissue darker than the signal expected from blood in that tissue indicates peptide accumulation in a region, tissue, structure or cell. For instance, the cartilage is avascular and contains minute amounts of blood. High signal in the kidneys indicates presence and accumulation of the peptide in the kidneys. FIG. 34 identifies the locations of the SEQ ID NO: 511 peptide distribution in joint and other cartilage as well as kidneys.

Example 43

Peptide Homing with Therapeutic Agents

This example describes certain exemplary therapeutic agents that are conjugated to a peptide. A peptide of the disclosure is expressed recombinantly or chemically synthesized and then is conjugated to an exemplary drug, such as paclitaxel or triamcinolone acetonide or budesonide using techniques known in the art, such as those described in Bioconjugate Techniques by Greg Hermanson (Elsevier Inc., 3$^{rd}$ Edition, 2013). One or more drugs is conjugated per peptide, or an average of less than one drug is conjugated per peptide.

Coupling of these drugs to a peptide of any of SEQ ID NO: 508-SEQ ID NO: 758 or SEQ ID NO: 798-SEQ ID NO: 1048 targets the drug to the cartilage of the subject. One or more drug-peptide conjugates are administered to a human or animal.

Example 44

Peptide Homing to an Arthritic Joint

This example illustrates peptide homing to cartilage in humans or animals with arthritis. A peptide of the present disclosure is expressed recombinantly or chemically synthesized and is used directly, after radiolabeling, or after conjugation to a fluorophore or therapeutic compound. A peptide is selected from any one of the peptides of SEQ ID NO: 508-SEQ ID NO: 758 or SEQ ID NO: 798-SEQ ID NO: 1048. The peptide or peptide conjugate is administered to a human or animal subcutaneously, intravenously, or orally, or is injected directly into a joint intraarticularly. The peptide or peptide conjugate homes to cartilage.

Example 45

Peptide Homing to Cartilage in Non-Human Animals

This example illustrates a peptide or peptide conjugate of this disclosure homing to cartilage in non-human animals. Non-human animals include but are not limited to guinea pigs, rabbits, dog, cats, horses, rats, mice, cows, pigs, non-human primates, and other non-human animals. A peptide of the present disclosure is recombinantly expressed or chemically synthesized and are used directly, after radiolabeling, or after conjugation to a fluorophore or therapeutic compound. The peptide is selected from any one of the peptides of SEQ ID NO: 508-SEQ ID NO: 758 or SEQ ID NO: 798-SEQ ID NO: 1048. The resulting peptide or peptide conjugate is administered to a non-human animal subcutaneously, intravenously, or orally, or is injected directly into a joint intra-articularly. Biodistribution is assessed by LC/MS, autoradiography, positron emission tomography (PET), or fluorescence imaging. A peptide or peptide conjugate is homed to cartilage in non-human animals.

Example 46

Whole Body Fluorescence and Isolated Limb Fluorescence of Homing Peptides

This example illustrates whole body fluorescence and isolated limb fluorescence of peptide homers of this disclosure. Any peptide of the present disclosure is chemically conjugated to one molecule of a near infrared fluorophore, at the N-terminus of the peptide via an active NHS ester on the dye. A dose of 10 nmol of each peptide conjugated to a fluorophore is administered to Female Harlan athymic nude mice, weighing 20-25 g, and is administered via tail vein injection. Each experiment is done at least in duplicate (n=2 mice per group). The peptide fluorophore conjugate is allowed to freely circulate for the described time period before the mice were euthanized at various time points. Mice are evaluated for peptide distribution of the peptide fluorescence in whole body imaging and in isolated hind limb imaging.

For Whole body fluorescence (WBF), at the end of the dosing period, mice are frozen in a hexane/dry ice bath and then embedded in a frozen block of carboxymethylcellulose. Whole animal sagittal slices are prepared that resulted in thin frozen sections for imaging. Thin frozen sections are obtained using a microtome and allowed visualization of tissues. Sections are allowed to dessicate in a freezer prior to imaging. WBF is performed on fluorescent sections, which are scanned on a Li-Cor Odyssey scanner at a setting of 169 μm resolution, medium quality, 700 channel, L-2.0 intensity.

For isolated hind limb fluorescence studies, mice are euthanized by $CO_2$ asphyxiation at the end of the dosing period. The right hind limb is removed at the hip joint and imaged on a Spectrum IVIS imager (ex/em: 675 nm. 720 nm) with a 1 second exposure length and a focal height of 0.5 cm. Limbs are imaged with skin removed and with muscle removed.

Example 47

Whole Body Autoradiography of Homing Peptides

This example illustrates whole body autoradiography of peptide homers of this disclosure. Peptides are radiolabeled by methylating lysines at the N-terminus as described in EXAMPLE 35. As such, the peptide may contain methyl or dimethyl lysines and a methylated or dimethlyated amino terminus. A dose of 100 nmol radiolabeled peptide is administered via tail vein injection in Female Harlan athymic nude mice, weighing 20-25 g. The experiment is done in at least duplicate (n=2 animals per group). In some animals, kidneys are ligated to prevent renal filtration of the radiolabled peptides and extend plasma half-life. Each radiolabeled peptide is allowed to freely circulate within the animal for the described time period before the animals were euthanized and sectioned.

Whole body autoradiography (WBA) sagittal sectioning is performed as follows. At the end of the dosing period, mice are frozen in a hexane/dry ice bath and then embedded in a frozen block of carboxymethylcellulose. Whole animal sagittal slices are prepared that resulted in thin frozen sections for imaging. Thin frozen sections are obtained using a microtome and allowed visualization of tissues such as brain, tumor, liver, kidney, lung, heart, spleen, pancreas, muscle, adipose, gall bladder, upper gastrointestinal tract, lower gastrointestinal tract, bone, bone marrow, reproductive tract, eye, cartilage, stomach, skin, spinal cord, bladder, salivary gland, and more. Sections are allowed to dessicate in a freezer prior to imaging.

For the autoradiography imaging, tape mounted thin sections are freeze dried and radioactive samples were exposed to phosphoimager plates for 7 days. These plates are developed and the signal (densitometry) from each organ was normalized to the signal found in the cardiac blood of each animal. A signal in tissue darker than the signal expected from blood in that tissue indicates accumulation in a region, tissue, structure, or cell.

Example 48

Peptide Localization in Chondrocytes

This example illustrates binding of peptides of this disclosure to chondrocytes within cartilage in animals with intact kidneys. In one embodiment, animals are dosed and are processed as described in EXAMPLE 46 and EXAMPLE 47. At the end of the dosing period, animals are euthanized and cartilage is optionally removed for use in staining and imaging procedures. Whole animal sagittal slices are prepared that result in thin frozen sections being available for staining and imaging. One or more of the following cartilage components are identified in thin frozen sections or live cartilage explants using standard staining techniques: collagen fibrils, glycosaminoglycans, or chondrocytes. A peptide of this disclosure is found to localize to chondrocytes in cartilage, localized intracellularly or extracellularly bound or both. Localization is visualized and confirmed by microscopy.

In another embodiment, peptides or peptide-drug conjugates of this disclosure are administered in humans and are localized on or in chondrocytes in cartilage.

Example 49

Peptide Localization in Cartilage Extracellular Matrix

This example illustrates localization of peptides of this disclosure in cartilage extracellular matrix. In one embodiment, animals are dosed and are processed as described in EXAMPLE 46 and EXAMPLE 47 in animals with intact kidneys. At the end of the dosing period, animals are euthanized and cartilage is optionally removed for use in staining and imaging procedures. Whole animal sagittal slices are prepared that result in thin frozen sections being available for staining and imaging. Thin frozen sections or live cartilage explants are acquired, stained, and visualized as described in EXAMPLE 48. A peptide of the present disclosure is found to localize to the extracellular matrix in cartilage. The peptide may be bound to one or more components of the extracellular matrix, such as proteoglycans, glycosaminoglycans, aggrecan, decorin, or collagen. Localization is visualized and confirmed by microscopy.

In another embodiment, peptides or peptide-drug conjugates of this disclosure are administered in humans and are localized in cartilage extracellular matrix.

Example 50

Peptide Binding to Cartilage Explants

This example illustrates a peptide or peptide conjugation of this disclosure homing, targeting, being directed to, migrating to, being retained by, accumulating in, or binding to human and animal cartilage explants in culture. A peptide is selected from any one of the peptides of SEQ ID NO: 508-SEQ ID NO: 758 or SEQ ID NO: 798-SEQ ID NO: 1048. Peptides are recombinantly expressed or chemically synthesized and are used directly, after radiolabeling, or after conjugation to a fluorophore or therapeutic compound.

A peptide of peptide conjugate of this disclosure is incubated with cartilage explants derived from humans or animals. Peptides of peptide conjugate are found to bind to cartilage explants. The interaction with cartilage is confirmed using various methods that include but are not limited to liquid scintillation counting, confocal microscopy, immunohistochemistry, HPLC, or LC/MS. The peptide shows a higher level of signal than a control peptide that is administered that is not a cartilage binding peptide.

Example 51

Effects of Peptide on Ion Channels

This example describes the interaction between peptides of the present disclosure and ion channels. Ion channels can be associated with pain and can be activated in disease states such as arthritis. A peptide of the disclosure is expressed and administered in a pharmaceutical composition to a patient to treat a joint condition or disease associated with an ion channel and treatable by binding, blocking, or interacting with the ion channel. Ion channels, such as Nav 1. 7, are inhibited by peptides of the present disclosure. A given peptide is expressed recombinantly or chemically synthesized, wherein the peptide selected from SEQ ID NO: 508-SEQ ID NO: 758 or SEQ ID NO: 798-SEQ ID NO: 1048. Following expression or synthesis, the peptide is used directly or conjugated to a therapeutic compound, such as those described herein. A peptide of the present disclosure selectively interacts with ion channels, or is mutated in order to interact with ion channels. For example, a peptide of this disclosure is bound to Nav 1. 7 or Nav 1. 7 is blocked by a peptide of this disclosure. When the peptide is administered to a human subject, Nav 1.7 signaling is reduced in the tissues in proximity to the joints, and pain relief is thereby provided.

Example 52

Peptide-Fc Protein Fusions

This example illustrates making and using peptide-Fc protein fusions. A peptide of SEQ ID NO: 592 was recombinantly expressed with the sequence for the human IgG1 Fc protein in HEK293 cells to yield a sequence of SEQ ID NO: 1049 (METDTLLLWVLLLWVPGSTGGSGVPINVRCRGSRDCLDPCRRAGMRFGRCINSRCHCTPGGSGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTIS KAKGQPREPQVYTLPPSRDELTKNQVSLTCLVKGFYPSDIAVEWESNGQPENNYKTTPPVLDSDGSFFLYSK-LTVDKSRWQQGNVFSCSVMHEALHNHYTQKSLSLSPGK).

The sequence of any peptide of this disclosure is expressed as a fusion protein with either murine or human Fc by adding a secretion signal sequence to the N-terminus and an Fc sequence to the C-terminus. This creates a bivalent molecule with improved secretion properties. The larger peptide-Fc fusion is expressed in different mammalian or insect cell lines and is useful as a research reagent and a therapeutic.

Fc fusion to a peptide of SEQ ID NO: 592 to yield a sequence of SEQ ID NO: 1049 extends half-life and improves biodistribution of the peptide to cartilage. Any peptide of this disclosure is co-expressed with Fc protein to yield Fc-fusion peptides with longer half-life and improved homing to cartilage. In SEQ ID NO: 1049, the secretion signal sequence METDTLLLWVLLLWVPGSTG (SEQ ID NO: 1050) is followed by the peptide of SEQ ID NO: 592, and is followed by the sequence for Fc protein. Cleaving can be imprecise, resulting in cleavage at position 20 or position 21 of SEQ ID NO: 1049.

Example 53

Peptide Conjugate Hydrolysis

This example describes preparation of peptide conjugates having tunable hydrolysis rates. The peptide-drug conjugates described below are synthesized with the modification that instead of using succinic anhydride, other molecules are used to provide steric hindrance to hydrolysis or an altered local environment at the carbon adjacent to the final hydrolyzable ester. In one exemplary conjugate, the peptide-drug conjugate is synthesized with tetramethyl succinic anhydride to generate hindered esters, which causes a decreased rate of hydrolysis. In another exemplary conjugate, one methyl group is present at the adjacent carbon. In another exemplary conjugate, two methyl groups are present at the adjacent carbon. In another exemplary conjugate, one ethyl group is present at the adjacent carbon. In another exemplary conjugate, two ethyl groups are present at the adjacent carbon. In another exemplary conjugate, the carbon linker length is increased such as by using glutaric anhydride instead of succinic anhydride, increasing the local hydrophobicity and lowering the hydrolysis rate. In another exemplary conjugate, a hydroxyl group is located on the adjacent carbon, increasing the local hydrophilicity and increasing the hydrolysis rate. The rate of hydrolysis in these exemplary conjugates is therefore adjusted, preventing premature cleavage and ensuring that the majority of peptide-dexamethasone conjugates accumulate in cartilage prior to release of the drug by hydrolysis but that the dexamethasone is also released in the cartilage in a timely manner.

The resulting peptide conjugates are administered to a human or animal subcutaneously, intravenously, orally, or injected directly into a joint to treat disease.

Example 54

Peptide Conjugates with Stable Linkers

This example describes preparation of peptide conjugates with stable linkers. A peptide of the disclosure is expressed recombinantly or is chemically synthesized. The peptide is conjugated to a detectable agent or an active agent via a stable linker, such as an amide linkage or a carbamate linkage. The peptide is conjugated to a detectable agent or an active agent via a stable linker, such as an amide bond using standard 1-ethyl-3-(3-dimethylaminopropyl)carbodiimide (EDC) or dicylcohexylcarbodiimide (DCC) based chemistry or thionyl chloride or phosphorous chloride-based bioconjugation chemistries.

A peptide and drug conjugated via a linker are described with the formula Peptide-A-B-C-Drug, wherein the linker is A-B-C. A can be a stable amide link that is formed by reacting with an amine on the peptide with a linker containing a tetrafluorophenyl (TFP) ester or an NHS ester. A can also be a stable carbamate linker that is formed by reacting with an amine on the peptide imidazole carbamate active intermediate formed by the reaction of CDI with a hydroxyl on the linker. A can also be a stable secondary amine linkage that is formed by reductive alkylation of the amine on the peptide with an aldehyde or ketone group on the linker. A can also be a stable thioether linker formed using a maleimide or bromoacetamide in the linker with a thiol in the peptide, a triazole linker, a stable oxime linker, or an oxacarboline linker. B is ($—CH2-$)$_x$-, a short PEG ($—CH_2CH_2O—$)$_x$ (x is 0-20). Alternatively, spacers within the linker is optional and can be included or not at all. C is an amide bond formed with an amine or a carboxylic acid on the drug, a thioether formed between a maleimide on the linker and a sulfhydroyl on the drug, a secondary or tertiary amine, a carbamate, or other stable bonds. Any linker chemistry described in "Current ADC Linker Chemistry," Jain et al., *Pharm Res,* 2015 DOI 10. 1007/si 1095-015-1657-7 can be used.

The resulting peptide conjugates are administered to a human or animal subcutaneously, intravenously, orally, or injected directly into a joint to treat disease. The peptide is not specifically cleaved from the detectable agent or active agent via a targeted mechanism. The peptide can be degraded by mechanisms such as catabolism, releasing a drug that is modified or not modified form its native form (Singh, Luisi, and Pak, *Pharm Res* 32:3541-3571 (2015)). The peptide drug conjugate exerts its pharmacological activity while still intact, or while partially or fully degraded, metabolized, or catabolized.

Example 55

Peptide Conjugates with Cleavable Linkers

This example describes preparation of peptide conjugates having cleavable linkers. A peptide of the disclosure is expressed recombinantly or chemically synthesized. A peptide and drug are conjugated via a linker and is described with the formula Peptide-A-B-C-Drug, wherein the linker is A-B-C. A is a stable amide link such as that formed by reacting an amine on the peptide with a linker containing a tetrafluorophenyl (TFP) ester or an NHS ester. A can also be a stable carbamate linker such as that formed by reacting an amine on the peptide with an imidazole carbamate active intermediate formed by reaction of CDI with a hydroxyl on the linker. A can also be a stable secondary amine linkage such as that formed by reductive alkylation of the amine on the peptide with an aldehyde or ketone group on the linker. A can also be a stable thioether linker formed using a maleimide or bromoacetamide in the linker with a thiol in the peptide, a triazole linker, a stable oxime linker, or a oxacarboline linker. B is ($—CH2-$)$_x$- or a short PEG ($—CH_2CH_2O—$)$_x$ (x is 0-20) or other spacers or no spacer. C is an ester bond to the hydroxyl or carboxylic acid on the drug, or a carbonate, hydrazone, or acylhydrazone, designed for hydrolytic cleavage. The hydrolytic rate of cleavage is varied by varying the local environment around the ester, including carbon length ($—CH2-$)$_x$, steric hindrance (including adjacent side groups such as methyl, ethyl, cyclic), hydrophilicity or hydrophobicity. Hydrolysis rate is affected by local pH, such as lower pH in certain compartments of the body or of the cell such as endosomes and lysosomes or diseased tissues. C is a pH sensitive group such as a hydrazone or oxime linkage. Alternatively C is a disulfide bond designed to be released by reduction, such as by glutathione. Alternatively C (or A-B-C) is a peptidic linkage design for cleavable by enzymes. Optionally, a self-immolating group such as pABC is included to cause release of a free unmodified drug upon cleavage (Antibody-Drug Conjugates: Design, Formulation, and Physicochemical Stability, Singh, Luisi, and Pak. Pharm Res (2015) 32:3541-3571). The linker is cleaved by enzymes such as esterases, matrix metalloproteinases, cathepsins such as cathepsin B, glucuronidases, a protease, or thrombin. Alternatively, the bond designed for cleavage is at A, rather than C, and C could be a stable bond or a cleavable bond. An alternative design is to have stable linkers (such as amide or carbamate) at A and C and have a cleavable linker in B, such as a disulfide bond. The rate of reduction is modulated by local effects such as steric hindrance from methyl or ethyl groups or modulating hydrophobicity/hydrophilicity.

The resulting peptide conjugates are administered to a human or animal subcutaneously, intravenously, orally, or injected directly into a joint to treat disease.

Example 56

Acetylsalicylic Acid Peptide Conjugate

This example describes the conjugation of acetylsalicylic acid to a peptide using a lactic acid linker. A conjugate is produced from a mixture of (R,S)-acetylsalicylic acid, lactic acid, and a peptide:

The acetylsalicylic acid -lactic acid linker conjugate depicted above is then reacted with a lysine or the N-terminus of a cystine-dense peptide to create an acetylsalicylic acid -lactic acid-peptide conjugate. The cystine-dense peptide is selected from the peptides of SEQ ID NO: 508-SEQ ID NO: 758 or SEQ ID NO: 798-SEQ ID NO: 1048.

Acetylsalicylic acid is currently dosed as an enantiomeric mixture, in which enantiomers with a single racemic stereocenter are very difficult to separate. As in the reaction scheme (I), a diastereomer with two chiral centers is created by the addition of a chiral linker such as L-lactic acid. Since diastereomers are easily separated, the active enantiomer of acetylsalicylic acid conjugated to the lactic acid linker can be purified prior to conjugation to a cystine-dense peptide. The chemical synthesis can use any conjugation techniques known in the art, such as described in *Bioconjugate Techniques* by Greg Hermanson and in "Ketorolac-dextran conjugates: synthesis, in vitro, and in vivo evaluation:" *Acta Pharm.* 57 (2007) 441-450, Vyas, Trivedi, and Chaturvedi. The conjugate can display anti-inflammatory activity, or free acetylsalicylic acid is released from the conjugate to provide anti-inflammatory activity. The free acetylsalicylic acid can result from hydrolysis that occurs after administration, such as hydrolysis at the ester bond. By dosing the conjugate containing the cartilage homing peptide, a higher AUC of acetylsalicylic acid delivery to the joint may be achieved than would be achieved by systemic dosing of acetylsalicylic acid alone.

Such peptide-drug conjugates can be made using either a cleavable or stable linker as described herein (e. g., EXAMPLES 54 and 55).

Example 57

Acetylsalicylic Acid Peptide Conjugate

This example describes the conjugation of acetylsalicylic acid to a peptide using a PEG linker. A conjugate is produced using acetylsalicylic acid and a PEG linker, which forms an ester bond that can hydrolyze as described in "In vitro and in vivo study of poly(ethylene glycol) conjugated ibuprofen to extend the duration of action," Scientia Pharmaceutica, 2011, 79:359-373, Nayak and Jain. Fischer esterification is used to conjugate ibuprofen with a short PEG, e.g., with triethylene glycol, to yield ibuprofen-ester-PEG-OH.

Following preparation of the PEG-ibuprofen conjugate as shown above, the hydroxyl moiety of PEG is activated with N,N'-disuccinimidyl carbonate (DSC) to form ibuprofen-ester-PEG-succinimidyl carbonate, which is then reacted with a lysine or the N-terminus of a cystine-dense peptide to form an ibuprofen-ester-PEG-peptide conjugate. The cystine-dense peptide is selected from any one of the peptides of sequence SEQ ID NO: 508-SEQ ID NO: 758 or SEQ ID NO: 798-SEQ ID NO: 1048. The conjugate can display anti-inflammatory activity, or free ibuprofen is released from the conjugate to provide anti-inflammatory activity. The free ibuprofen can result from hydrolysis that occurs after administration, such as hydrolysis at the ester bond.

Ibuprofen-peptide conjugates are administered to a subject in need thereof. The subject can be a human or a non-human animal.

Such peptide-drug conjugates can be made using either a cleavable or stable linker as described herein (e.g., EXAMPLES 54 and 55).

Example 58

Dexamethasone Peptide Conjugate

This example describes different methods of conjugating dexamethasone with a peptide of this disclosure. A peptide of SEQ ID NO: 592 was recombinantly expressed. Dexamethasone was readily conjugated to a peptide of this disclosure using a dicarboxylic acid linker. The peptide-dexamethasone conjugate was made by first converting dexamethasone to a hemisuccinate by reacting it with succinic anhydride. The hemisuccinate was then converted to a succinate carboxylic acid containing an active ester, using dicyclohexyl carbodiimide (DCC) or 1-ethyl-3-(3-dimethylamninopropyl)carbodiimide (EDC) in the presence of N-hydroxy succinimide (NHS). This active ester was then reacted with a lysine or the N-terminus of a cystine-dense peptide to create a dexamethasone-carboxylic acid-peptide conjugate. Methods such as those described in "Functionalized derivatives of hyaluronic acid oligosaccharides: drug carriers and novel biomaterials" Bioconjugate Chemistry 1994, 5, 339-347, Pouyani and Prestwich, and *Bioconjugate Techniques* by Greg Hermanson can be used (Elsevier Inc., 3$^{rd}$ Edition, 2013).

Peptide-dexamethasone conjugates were prepared by coupling dexamethasone to the peptides of this disclosure using standard coupling-reagent chemistry. For example, dexamethasone conjugates were made by reacting dexamethasone hemigluterate with 1.05 molar equivalents of 1,1'-carbonyldiimidazole in anhydrous DMSO in an inert atmosphere. After 30 minutes, excess dexamethasone in anhydrous DMSO was added along with two molar equivalents of anhydrous trimethylamine. The N-hydroxysuccinimide ester of the peptide-dexamethasone conjugate was generated to form a shelf-stable intermediate for later reaction with an amine-containing carrier. The N-terminal dexamethasone-peptide conjugate (SEQ ID NO: 592B) was verified by electrospray mass spectrometry (ES-MS) within a 10 ppm error.

A peptide of any of the sequences of this disclosure including SEQ ID NO: 508-SEQ ID NO: 758 or SEQ ID NO: 798-SEQ ID NO: 1048, are conjugated to dexamethasone using the methods described above.

Such peptide-drug conjugates can be made using either a cleavable or stable linker as described herein (e.g., EXAMPLES 54 and 55).

Example 59

Beclomethasone Monopropionate Peptide Conjugates

This example describes conjugation of a peptide of SEQ ID NO: 511 or SEQ ID NO: 592 of this disclosure to beclomethasone monopropionate. Beclomethasone monopropionate is readily conjugated to any peptide disclosed herein via a dicarboxylic acid linker. The dicarboxylic acid linker is a linear dicarboxylic acid, such as succinic acid, or a related cyclic anhydride, such as succinic anhydride. Reactions with anhydrides can proceed under simple conditions. For example, the reaction of beclomethasone monopropionate with five molar equivalents of glutaric anhydride is carried out in anhydrous pyridine at room temperature. Reactions with dicarboxylic acids can occur using standard carbodiimide coupling methods. For example, beclomethasone monopropionate is reacted with one molar equivalent dimethylsuccinic acid, one molar equivalent 1-ethyl-3-(3-dimethylaminopropyl)carbodiimide (or another carbodiimide), and 0.2 molar equivalents of 40-dimethylamino pyridine.

The same methods as described in EXAMPLE 53 are used to adjust the rate of hydrolysis of peptide-beclomethasone monopropionate conjugates, preventing premature cleavage and ensuring that the beclomethasone monopropionate of peptide-beclomethasone monopropionate conjugates accumulate in cartilage.

Peptide-beclomethasone monopropionate conjugates are prepared by coupling beclomethasone monopropionate to the peptides of this disclosure using standard coupling-reagent chemistry. The peptide-beclomethasone monopropionate conjugate was made by first converting beclomethasone monopropionate to a hemisuccinate by reacting it with succinic anhydride. The hemisuccinate was then converted to a succinate carboxylic acid containing an active ester, using dicyclohexyl carbodiimide (DCC) or 1-ethyl-3-(3-dimethylamninopropyl)carbodiimide (EDC) in the presence of N-hydroxy succinimide (NHS). This active ester was then reacted with a lysine or the N-terminus of a peptide to create a beclomethasone monopropionate -carboxylic acid-peptide conjugate. Methods such as those described in "Functionalized derivatives of hyaluronic acid oligosaccharides: drug carriers and novel biomaterials" *Bioconjugate Chemistry* 1994, 5, 339-347, Pouyani and Prestwich, and *Bioconjugate Techniques* by Greg Hermanson can be used (Elsevier Inc., 3$^{rd}$ Edition, 2013).

Peptide-beclomethasone monopropionate conjugates were prepared by coupling beclomethasone monopropionate to the peptides of this disclosure using standard coupling-reagent chemistry. For example, beclomethasone monopropionate conjugates were made by reacting beclomethasone monopropionate hemigluterate with 1.05 molar equivalents of 1,1'-carbonyldiimidazole in anhydrous DMSO in an inert atmosphere. After 30 minutes, excess beclomethasone monopropionate in anhydrous DMSO was added along with two molar equivalents of anhydrous trimethylamine. The N-hydroxysuccinimide ester of the peptide-beclomethasone monopropionate conjugate was generated to form a shelf-stable intermediate for later reaction with an amine-containing carrier.

Beclomethasone monopropionate is also readily conjugated to any peptide disclosed herein via a dicarboxylic acid linker. The dicarboxylic acid linker is a linear dicarboxylic acid, such as succinic acid, or a related cyclic anhydride, such as succinic anhydride. Reactions with anhydrides can proceed under simple conditions. For example, the reaction of beclomethasone monopropionate with five molar equivalents of glutaric anhydride is carried out in anhydrous pyridine at room temperature. Reactions with dicarboxylic acids can occur using standard carbodiimide coupling methods. For example, beclomethasone monopropionate is reacted with one molar equivalent dimethylsuccinic acid, one molar equivalent 1-ethyl-3-(3-dimethylaminopropyl)carbodiimide (or another carbodiimide), and 0.2 molar equivalents of 40-dimethylamino pyridine. The peptide-beclomethasone monopropionate conjugates are administered to a subject in need thereof and home, target, are directed to, are retained by, accumulate in, migrate to, and/or bind to cartilage and/or kidneys. The subject is a human or animal and has inflammation in the cartilage or kidney tissues. Upon administration of the peptide-beclomethasone monopropionate conjugates, the cartilage and/or kidney inflammation is alleviated.

The peptide can also be a peptide of SEQ ID NO: 517. The peptide can be any peptide with the sequence selected SEQ ID NO: 508-SEQ ID NO: 758 or SEQ ID NO: 798-SEQ ID NO: 1048.

Such peptide-drug conjugates are made using either a cleavable or stable linker as described herein (e.g., EXAMPLES 54 and 55).

Example 60

Desciclesonide Peptide Conjugates

This example describes conjugation of a peptide of SEQ ID NO: 683 or SEQ ID NO: 671 of this disclosure to desciclesonide. Ciclesonide is a prodrug that is metabolized in vivo to the active metabolite desciclesonide. By conjugating desciclesonide to a peptide via an ester linker, upon hydrolysis the released drug would be desciclesonide, just as after systemic administration of ciclesonide the active metabolite desciclesonide is present and active. Desciclesonide is readily conjugated to any peptide disclosed herein via a dicarboxylic acid linker. The dicarboxylic acid linker is a linear dicarboxylic acid, such as succinic acid, or a related cyclic anhydride, such as succinic anhydride. Reactions with anhydrides can proceed under simple conditions. For example, the reaction of desciclesonide with five molar equivalents of glutaric anhydride is carried out in anhydrous pyridine at room temperature. Reactions with dicarboxylic acids can occur using standard carbodiimide coupling methods. For example, desciclesonide is reacted with one molar equivalent dimethylsuccinic acid, one molar equivalent 1-ethyl-3-(3-dimethylaminopropyl)carbodiimide (or another carbodiimide), and 0.2 molar equivalents of 40-dimethylamino pyridine.

The same methods as described in EXAMPLE 53 are used to adjust the rate of hydrolysis of peptide-desciclesonide conjugates, preventing premature cleavage and ensuring that the desciclesonide of peptide-desciclesonide conjugates accumulate in cartilage.

Desciclesonide is also readily conjugated to any peptide disclosed herein via a dicarboxylic acid linker. The dicarboxylic acid linker is a linear dicarboxylic acid, such as succinic acid, or a related cyclic anhydride, such as succinic anhydride. Reactions with anhydrides can proceed under simple conditions. For example, the reaction of desciclesonide with five molar equivalents of glutaric anhydride is carried out in anhydrous pyridine at room temperature. Reactions with dicarboxylic acids can occur using standard carbodiimide coupling methods. For example, desciclesonide is reacted with one molar equivalent dimethylsuccinic acid, one molar equivalent 1-ethyl-3-(3-dimethylaminopropyl)carbodiimide (or another carbodiimide), and 0.2 molar equivalents of 40-dimethylamino pyridine. The peptide-desciclesonide conjugates are administered to a subject in need thereof and home, target, are directed to, are retained by, accumulate in, migrate to, and/or bind to cartilage and/or kidneys. The subject is a human or animal and has inflammation in the cartilage or kidney tissues. Upon administration of the peptide-desciclesonide conjugates, the cartilage and/or kidney inflammation is alleviated.

The peptide-desciclesonide conjugates are administered to a subject in need thereof and home, target, are directed to, are retained by, accumulate in, migrate to, and/or bind to cartilage and/or kidneys. The subject is a human or animal and has inflammation in the cartilage or kidney tissues. Upon administration of the peptide-desciclesonide conjugates, the cartilage and/or kidney inflammation is alleviated.

The peptide can also be a peptide of SEQ ID NO: 680. The peptide can be any peptide with the sequence selected from SEQ ID NO: 508-SEQ ID NO: 758 or SEQ ID NO: 798-SEQ ID NO: 1048.

Such peptide-drug conjugates are made using either a cleavable or stable linker as described herein (e.g., EXAMPLES 54 and 55).

Example 61

Desciclesonide Peptide Conjugates

This example describes conjugation of a peptide of SEQ ID NO: 683 or SEQ ID NO: 671 of this disclosure to desciclesonide. Ciclesonide is a prodrug that is metabolized in vivo to the active metabolite desciclesonide. By conjugating desciclesonide to a peptide via an ester linker, upon hydrolysis the released drug would be desciclesonide, just as after systemic administration of ciclesonide the active metabolite desciclesonide is present and active. Desciclesonide is readily conjugated to any peptide disclosed herein via a stable linker.

The peptide-desciclesonide conjugates are administered to a subject in need thereof and home, target, are directed to, are retained by, accumulate in, migrate to, and/or bind to cartilage and/or kidneys. The subject is a human or animal and has inflammation in the cartilage or kidney tissues. Upon administration of the peptide-desciclesonide conjugates, the cartilage and/or kidney inflammation is alleviated.

The peptide can also be a peptide of SEQ ID NO: 680. The peptide can be any peptide with the sequence selected SEQ ID NO: 508-SEQ ID NO: 758 or SEQ ID NO: 798-SEQ ID NO: 1048.

Such peptide-drug conjugates are made using either a cleavable or stable linker as described herein (e.g., EXAMPLES 54 and 55).

Example 62

Peptide-Ustekinumab Conjugates

This example describes conjugation of a peptide of SEQ ID NO: 590 this disclosure to ustekinumab. Ustekinumab is readily conjugated to any peptide disclosed herein via stan-

849 dard chemistries such as those described in, but not limited to, *Bioconjugate Techniques* by Greg Hermanson (Elsevier Inc., 3$^{rd}$ edition, 2013). Alternatively the peptide-active agent of this Example can be expressed as a fusion protein. From one to eight peptides are linked to ustekinumab.

The peptide-ustekinumab conjugates are administered to a subject in need thereof and home, target, are directed to, are retained by, accumulate in, migrate to, and/or bind to cartilage. The subject is a human or animal and has psoriatic arthritis. Upon administration of the peptide-ustekinumab conjugates, the psoriatic arthritis condition is alleviated.

The peptide can also be a peptide of SEQ ID NO: 520. The peptide can be any peptide with the sequence selected from SEQ ID NO: 508-SEQ ID NO: 758 or SEQ ID NO: 798-SEQ ID NO: 1048.

Example 63

Peptide-Xeljanz Conjugates

This example describes conjugation of a peptide of SEQ ID NO: 671 this disclosure to xeljanz. Xeljanz is readily conjugated to any peptide disclosed herein via standard chemistries such as those described in, but not limited to, *Bioconjugate Techniques* by Greg Hermanson (Elsevier Inc., 3$^{rd}$ edition, 2013). From one to eight peptides are linked to xeljanz.

The peptide-xeljanz conjugates are administered to a subject in need thereof and home, target, are directed to, are retained by, accumulate in, migrate to, and/or bind to cartilage. The subject is a human or animal and has rheumatoid arthritis. Upon administration and homing of peptide-xeljanz conjugates, the rheumatoid arthritis condition is alleviated.

The peptide can also be a peptide of SEQ ID NO: 669. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 64

Peptide-IL-17 Inhibitor Conjugates

This example describes conjugation of a peptide of SEQ ID NO: 592 this disclosure to an IL-17 inhibitor. An IL-17 inhibitor is readily conjugated to any peptide disclosed herein via standard chemistries such as those described in, but not limited to, *Bioconjugate Techniques* by Greg Hermanson (Elsevier Inc., 3$^{rd}$ edition, 2013).

The peptide-IL-17 inhibitor conjugates are administered to a subject in need thereof and home, target, are directed to, are retained by, accumulate in, migrate to, and/or bind to cartilage. The subject is a human or animal and has ankylosing spondylitis. Upon administration and homing of peptide-IL-17 inhibitor conjugates, the ankylosing spondylitis condition is alleviated.

The peptide can also be a peptide of SEQ ID NO: 595. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

850

Example 65

Peptide-Iguratimod Conjugates

This example describes conjugation of a peptide of SEQ ID NO: 683 this disclosure to iguratimod. Iguratimod is readily conjugated to any peptide disclosed herein via standard chemistries such as those described in, but not limited to, *Bioconjugate Techniques* by Greg Hermanson (Elsevier Inc., 3$^{rd}$ edition, 2013).

The peptide-iguratimod conjugates are administered to a subject in need thereof and home, target, are directed to, are retained by, accumulate in, migrate to, and/or bind to kidneys. The subject is a human or animal and has rheumatoid arthritis. Upon administration and homing of peptide-iguratimod conjugates, the rheumatoid arthritis condition is alleviated.

The peptide can also be a peptide of SEQ ID NO: 510. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 66

Peptide Mycophenolic Acid Conjugates

This example describes conjugation of a peptide of SEQ ID NO: 511 this disclosure to mycophenolic acid. Mycophenolic acid is readily conjugated to any peptide disclosed herein via standard chemistries such as those described in, but not limited to, *Bioconjugate Techniques* by Greg Hermanson (Elsevier Inc., 3$^{rd}$ edition, 2013).

The peptide-mycophenolic acid conjugates are administered to a subject in need thereof and home, target, are directed to, are retained by, accumulate in, migrate to, and/or bind to kidneys. The subject is a human or animal and has organ transplantation, infection, cancer, or other kidney disorders. Upon administration and homing of peptide-mycophenolic acid conjugates, the organ transplantation, infection, cancer, other kidney disorders condition is alleviated.

The peptide can also be a peptide of SEQ ID NO: 591. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 67

Peptide-Tacrolimus Conjugates

This example describes conjugation of a peptide of SEQ ID NO: 592 this disclosure to tacrolimus. Tacrolimus is readily conjugated to any peptide disclosed herein via standard chemistries such as those described in, but not limited to, *Bioconjugate Techniques* by Greg Hermanson (Elsevier Inc., 3$^{rd}$ edition, 2013).

The peptide-tacrolimus conjugates are administered to a subject in need thereof and home, target, are directed to, are retained by, accumulate in, migrate to, and/or bind to kidneys. The subject is a human or animal and has organ transplantation, any other kidney disease. Upon administra-

Example 68

Peptide-Secukinumab Conjugates

This example describes conjugation of a peptide of SEQ ID NO: 590 this disclosure to secukinumab. Secukinumab is readily conjugated to any peptide disclosed herein via standard chemistries such as those described in, but not limited to, Bioconjugate Techniques by Greg Hermanson (Elsevier Inc., $3^{rd}$ edition, 2013). From one to eight peptides are linked to secukinumab. Alternatively the peptide-active agent of this Example can be expressed as a fusion protein.

The peptide-secukinumab conjugates are administered to a subject in need thereof and home, target, are directed to, are retained by, accumulate in, migrate to, and/or bind to cartilage. The subject is a human or animal and has ankylosing spondylitis. Upon administration and homing of peptide-secukinumab acid conjugates, the ankylosing spondylitis condition is alleviated.

The peptide can also be a peptide of SEQ ID NO: 508. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 69

Peptide-Sirukumab Conjugates

This example describes conjugation of a peptide of SEQ ID NO: 683 this disclosure to sirukumab. Sirukumab is readily conjugated to any peptide disclosed herein via standard chemistries such as those described in, but not limited to, Bioconjugate Techniques by Greg Hermanson (Elsevier Inc., $3^{rd}$ edition, 2013). From one to eight peptides are linked to sirukumab. Alternatively the peptide-active agent of this Example can be expressed as a fusion protein.

The peptide-sirukumab conjugates are administered to a subject in need thereof and home, target, are directed to, are retained by, accumulate in, migrate to, and/or bind to kidneys. The subject is a human or animal and has rheumatoid arthritis, immune diseases of the kidneys. Upon administration and homing of peptide-sirukumab conjugates, the rheumatoid arthritis, immune diseases of the kidneys condition is alleviated.

The peptide can also be a peptide of SEQ ID NO: 520. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 70

Peptide-Anifrolumab Conjugates

This example describes conjugation of a peptide of SEQ ID NO: 511 this disclosure to anifrolumab. Anifrolumab is readily conjugated to any peptide disclosed herein via standard chemistries such as those described in, but not limited to, Bioconjugate Techniques by Greg Hermanson (Elsevier Inc., $3^{rd}$ edition, 2013). From one to eight peptides are linked to anifrolumab. Alternatively the peptide-active agent of this Example can be expressed as a fusion protein.

The peptide-anifrolumab conjugates are administered to a subject in need thereof and home, target, are directed to, are retained by, accumulate in, migrate to, and/or bind to kidneys. The subject is a human or animal and has lupus nephritis. Upon administration and homing of peptide-anifrolumab conjugates, the lupus nephritis condition is alleviated.

The peptide can also be a peptide of SEQ ID NO: 669. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 71

Peptide-Denosumab Conjugates

This example describes conjugation of a peptide of SEQ ID NO: 592 this disclosure to denosumab. Denosumab is readily conjugated to any peptide disclosed herein via standard chemistries such as those described in, but not limited to, Bioconjugate Techniques by Greg Hermanson (Elsevier Inc., $3^{rd}$ edition, 2013). From one to eight peptides are linked to denosumab. Alternatively the peptide-active agent of this Example can be expressed as a fusion protein.

The peptide-denosumab conjugates are administered to a subject in need thereof and home, target, are directed to, are retained by, accumulate in, migrate to, and/or bind to cartilage. The subject is a human or animal and has osteoporosis. Upon administration and homing of peptide-denosumab conjugates, the osteoporosis condition is alleviated.

The peptide can also be a peptide of SEQ ID NO: 509. The peptide can be any peptide with the sequence selected SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 72

Peptide-Rituximab Conjugates

This example describes conjugation of a peptide of SEQ ID NO: 592 this disclosure to rituximab. Rituximab is readily conjugated to any peptide disclosed herein via standard chemistries such as those described in, but not limited to, Bioconjugate Techniques by Greg Hermanson (Elsevier Inc., $3^{rd}$ edition, 2013). From one to eight peptides are linked to rituximab. Alternatively the peptide-active agent of this Example can be expressed as a fusion protein.

The peptide-rituximab conjugates are administered to a subject in need thereof and home, target, are directed to, are retained by, accumulate in, migrate to, and/or bind to cartilage or kidneys. The subject is a human or animal and has rheumatoid arthritis, kidney transplant. Upon administration and homing of peptide-rituximab conjugates, the rheumatoid arthritis, kidney transplant condition is alleviated.

The peptide can also be a peptide of SEQ ID NO: 510. The peptide can be any peptide with the sequence selected SEQ ID NO: 508-SEQ ID NO: 758 or SEQ ID NO:

[Text continues at top of column: tion and homing of peptide-tacrolimus conjugates, the organ transplantation, any other kidney disease condition is alleviated. The peptide can also be a peptide of SEQ ID NO: 595. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).]

798-SEQ ID NO: 1048. Such peptide-drug conjugates can be made using either a cleavable or stable linker as described herein (e.g., EXAMPLES 54 and 55).

Example 73

Peptide-Omalizumab Conjugates

This example describes conjugation of a peptide of SEQ ID NO: 592 this disclosure to omalizumab. Omalizumab is readily conjugated to any peptide disclosed herein via standard chemistries such as those described in, but not limited to, *Bioconjugate Techniques* by Greg Hermanson (Elsevier Inc., 3$^{rd}$ edition, 2013). From one to eight peptides are linked to omalizumab. Alternatively the peptide-active agent of this Example can be expressed as a fusion protein.

The peptide-omalizumab conjugates are administered to a subject in need thereof and home, target, are directed to, are retained by, accumulate in, migrate to, and/or bind to kidneys. The subject is a human or animal and has kidney inflammation. Upon administration and homing of peptide-omalizumab conjugates, the kidney inflammation condition is alleviated.

The peptide can also be a peptide of SEQ ID NO: 591. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 74

Peptide-Abatacept Conjugates

This example describes conjugation of a peptide of SEQ ID NO: 683 this disclosure to abatacept. Abatacept is readily conjugated to any peptide disclosed herein via standard chemistries such as those described in, but not limited to, *Bioconjugate Techniques* by Greg Hermanson (Elsevier Inc., 3$^{rd}$ edition, 2013). From one to eight peptides are linked to abatacept. Alternatively the peptide-active agent of this Example can be expressed as a fusion protein.

The peptide-abatacept conjugates are administered to a subject in need thereof and home, target, are directed to, are retained by, accumulate in, migrate to, and/or bind to kidneys. The subject is a human or animal and has rheumatoid arthritis, lupus nephritis, organ transplant, focal segmental glomerulosclerosis. Upon administration and homing of peptide-abatacept conjugates, the rheumatoid arthritis, lupus nephritis, organ transplant, focal segmental glomerulosclerosis condition is alleviated.

The peptide can also be a peptide of SEQ ID NO: 595. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 75

Peptide-Oxycodone Conjugates

This example describes conjugation of a peptide of SEQ ID NO: 671 this disclosure to oxycodone. Oxycodone is readily conjugated to any peptide disclosed herein via standard chemistries such as those described in, but not limited to, *Bioconjugate Techniques* by Greg Hermanson (Elsevier Inc., 3$^{rd}$ edition, 2013).

The peptide-oxycodone conjugates are administered to a subject in need thereof and home, target, are directed to, are retained by, accumulate in, migrate to, and/or bind to cartilage. The subject is a human or animal and has cartilage or kidney-related pain. Upon administration and homing of peptide-oxycodone conjugates, the cartilage-related pain condition is alleviated.

The peptide can also be a peptide of SEQ ID NO: 508. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 76

Peptide Capsaicin Conjugates

This example describes conjugation of a peptide of SEQ ID NO: 592 this disclosure to capsaicin. Capsaicin is readily conjugated to any peptide disclosed herein via standard chemistries such as those described in, but not limited to, *Bioconjugate Techniques* by Greg Hermanson (Elsevier Inc., 3$^{rd}$ edition, 2013).

The peptide-capsaicin conjugates are administered to a subject in need thereof and home, target, are directed to, are retained by, accumulate in, migrate to, and/or bind to cartilage. The subject is a human or animal and has cartilage-related pain. Upon administration and homing of peptide-capsaicin conjugates, the cartilage or kidney-related pain condition is alleviated.

The peptide can also be a peptide of SEQ ID NO: 520. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 77

Peptide-GSK2193874 Conjugates

This example describes conjugation of a peptide of SEQ ID NO: 590 this disclosure to GSK2193874. GSK2193874 is readily conjugated to any peptide disclosed herein via standard chemistries such as those described in, but not limited to, *Bioconjugate Techniques* by Greg Hermanson (Elsevier Inc., 3$^{rd}$ edition, 2013).

The peptide-GSK2193874 conjugates are administered to a subject in need thereof and home, target, are directed to, are retained by, accumulate in, migrate to, and/or bind to GSK2193874. The subject is a human or animal and has cartilage-related pain. Upon administration and homing of peptide-GSK2193874 conjugates, the cartilage-related pain condition is alleviated.

The peptide can also be a peptide of SEQ ID NO: 669. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 78

Peptide BHIB023 Conjugates

This example describes conjugation of a peptide of SEQ ID NO: 683 this disclosure to BIIB023. BIIB023 is readily conjugated to any peptide disclosed herein via standard chemistries such as those described in, but not limited to, *Bioconjugate Techniques* by Greg Hermanson (Elsevier Inc., 3$^{rd}$ edition, 2013). From one to eight peptides are linked to BIIB023. Alternatively the peptide-active agent of this Example can be expressed as a fusion protein.

The peptide-BIIB023 conjugates are administered to a subject in need thereof and home, target, are directed to, are retained by, accumulate in, migrate to, and/or bind to cartilage. The subject is a human or animal and has lupus nephritis or rheumatoid arthritis. Upon administration and homing of peptide-BIIB023 conjugates, the lupus nephritis or rheumatoid arthritis condition is alleviated.

The peptide can also be a peptide of SEQ ID NO: 509. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 79

Peptide-Anakinra Conjugates

This example describes conjugation or fusion of a peptide of SEQ ID NO: 671 or SEQ ID NO: 1034-SEQ ID NO: 1048 of this disclosure to anakinra. A linker is optionally used to conjugate the peptide to anakinra. Anakinra is readily conjugated to any peptide disclosed herein via standard chemistries such as those described in, but not limited to, *Bioconjugate Techniques* by Greg Hermanson (Elsevier Inc., 3$^{rd}$ edition, 2013). From one to eight peptides are linked to anakinra. Alternatively the peptide-active agent of this Example can be expressed as a fusion protein.

The peptide-anakinra conjugates or fusions are administered to a subject in need thereof and home, target, are directed to, are retained by, accumulate in, migrate to, and/or bind to cartilage. The subject is a human or animal and has lupus nephritis or rheumatoid arthritis. Upon administration and homing of peptide-anakinra conjugates or fusions, the lupus nephritis or rheumatoid arthritis condition is alleviated.

The peptide can also be a peptide of SEQ ID NO: 510. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 80

Peptide-IGF-1 Conjugates

This example describes conjugation of a peptide of SEQ ID NO: 592 this disclosure to IGF-1. IGF-1 is readily conjugated to any peptide disclosed herein via standard chemistries such as those described in, but not limited to, *Bioconjugate Techniques* by Greg Hermanson (Elsevier Inc., 3$^{rd}$ edition, 2013). From one to eight peptides are linked to IGF-1. Alternatively the peptide-active agent (where the active agent is the biologic of this Example) can be expressed as a fusion protein.

The peptide-IGF-1 conjugates are administered to a subject in need thereof and home, target, are directed to, are retained by, accumulate in, migrate to, and/or bind to cartilage. The subject is a human or animal and has renal cancer or arthritis. Upon administration and homing of peptide-IGF-1 conjugates, the renal cancer or arthritis condition is alleviated.

The peptide can also be a peptide of SEQ ID NO: 591. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 81

Peptide-Romosozumab Conjugates

This example describes conjugation of a peptide of SEQ ID NO: 590 this disclosure to Romosozumab. Romosozumab is readily conjugated to any peptide disclosed herein via standard chemistries such as those described in, but not limited to, *Bioconjugate Techniques* by Greg Hermanson (Elsevier Inc., 3$^{rd}$ edition, 2013). From one to eight peptides are linked to romosozumab. Alternatively the peptide-active agent of this Example can be expressed as a fusion protein.

The peptide-romosozumab conjugates are administered to a subject in need thereof and home, target, are directed to, are retained by, accumulate in, migrate to, and/or bind to cartilage. The subject is a human or animal and has osteoporosis. Upon administration and homing of peptide-romosozumab conjugates, the osteoporosis condition is alleviated.

The peptide can also be a peptide of SEQ ID NO: 595. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 82

Peptide-ZVAD-fmk Conjugates

This example describes conjugation of a peptide of SEQ ID NO: 671 this disclosure to ZVAD-fmk. ZVAD-fmk is readily conjugated to any peptide disclosed herein via standard chemistries such as those described in, but not limited to, *Bioconjugate Techniques* by Greg Hermanson (Elsevier Inc., 3$^{rd}$ edition, 2013). From one to eight peptides are linked to ZVAD-fmk. The peptide-ZVAD-fmk conjugates are administered to a subject in need thereof and home, target, are directed to, are retained by, accumulate in, migrate to, and/or bind to cartilage. The subject is a human or animal and has cartilage grafting, arthritis, surgical intervention, surgery for cartilage repair. Upon administration and homing of peptide-ZVAD-fmk conjugates, the cartilage grafting, arthritis, surgical intervention, surgery for cartilage repair condition is alleviated.

The peptide can also be a peptide of SEQ ID NO: 508. The peptide can be any peptide with the sequence selected from SEQ ID NO: 508-SEQ ID NO: 758 or SEQ ID NO: 798-SEQ ID NO: 1048. Such peptide-drug conjugates can

Example 83

Peptide-S-methylisothiourea Conjugates

This example describes conjugation of a peptide of SEQ ID NO: 592 this disclosure to S-methylisothiourea. S-methylisothiourea is readily conjugated to any peptide disclosed herein via standard chemistries such as those described in, but not limited to, *Bioconjugate Techniques* by Greg Hermanson (Elsevier Inc., 3$^{rd}$ edition, 2013).

The peptide-S-methylisothiourea conjugates are administered to a subject in need thereof and home, target, are directed to, are retained by, accumulate in, migrate to, and/or bind to cartilage. The subject is a human or animal and has arthritis surgery, kidney iron overload, renal ischemia reperfusion injury, or acute kidney injury. Upon administration and homing of peptide-S-methylisothiourea conjugates, the arthritis surgery, kidney iron overload, renal ischemia reperfusion injury, or acute kidney injury condition is alleviated.

The peptide can also be a peptide of SEQ ID NO: 517. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 83

Peptide-P188 Conjugates

This example describes conjugation of a peptide of SEQ ID NO: 590 this disclosure to P188. P188 is readily conjugated to any peptide disclosed herein via standard chemistries such as those described in, but not limited to, *Bioconjugate Techniques* by Greg Hermanson (Elsevier Inc., 3$^{rd}$ edition, 2013).

The peptide-P188 conjugates are administered to a subject in need thereof and home, target, are directed to, are retained by, accumulate in, migrate to, and/or bind to cartilage. The subject is a human or animal and has arthritis surgery. Upon administration and homing of peptide-P188 conjugates, the arthritis surgery condition is alleviated.

The peptide can also be a peptide of SEQ ID NO: 669. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 84

Peptide-Alendronate Conjugates

This example describes conjugation of a peptide of SEQ ID NO: 671 this disclosure to alendronate. Alendronate is readily conjugated to any peptide disclosed herein via standard chemistries such as those described in, but not limited to, *Bioconjugate Techniques* by Greg Hermanson (Elsevier Inc., 3$^{rd}$ edition, 2013).

The peptide-alendronate conjugates are administered to a subject in need thereof and home, target, are directed to, are retained by, accumulate in, migrate to, and/or bind to cartilage. The subject is a human or animal and has bone erosion. Upon administration and homing of peptide-alendronate conjugates, the bone erosion condition is alleviated.

The peptide can also be a peptide of SEQ ID NO: 506. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 85

Peptide-MIP-3a Conjugates

This example describes conjugation of a peptide of SEQ ID NO: 592 this disclosure to MIP-3a. MIP-3a is readily conjugated to any peptide disclosed herein via standard chemistries such as those described in, but not limited to, *Bioconjugate Techniques* by Greg Hermanson (Elsevier Inc., 3$^{rd}$ edition, 2013). From one to eight peptides are linked to MIP-3a. Alternatively the peptide-active agent of this Example can be expressed as a fusion protein The peptide-MIP-3a conjugates are administered to a subject in need thereof and home, target, are directed to, are retained by, accumulate in, migrate to, and/or bind to cartilage. The subject is a human or animal and has Joint injury, repair and regeneration of cartilage and bone. Upon administration and homing of peptide-MIP-3a conjugates, the Joint injury, repair and regeneration of cartilage and bone condition is alleviated.

The peptide can also be a peptide of SEQ ID NO: 510. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 86

Peptide-BMP-2 Conjugates

This example describes conjugation of a peptide of SEQ ID NO: 590 this disclosure to BMP-2. BMP-2 is readily conjugated to any peptide disclosed herein via standard chemistries such as those described in, but not limited to, *Bioconjugate Techniques* by Greg Hermanson (Elsevier Inc., 3$^{rd}$ edition, 2013). From one to eight peptides are linked to BMP-2. Alternatively the peptide-active agent of this Example can be expressed as a fusion protein.

The peptide-BMP-2 conjugates are administered to a subject in need thereof and home, target, are directed to, are retained by, accumulate in, migrate to, and/or bind to cartilage. The subject is a human or animal and has Joint repair. Upon administration and homing of peptide-BMP-2 conjugates, the Joint repair condition is alleviated.

The peptide can also be a peptide of SEQ ID NO: 591. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 87

Peptide-Icariin Conjugates

This example describes conjugation of a peptide of SEQ ID NO: 671 this disclosure to icariin. Icariin is readily conjugated to any peptide disclosed herein via standard chemistries such as those described in, but not limited to, *Bioconjugate Techniques* by Greg Hermanson (Elsevier Inc., 3$^{rd}$ edition, 2013).

The peptide-icariin conjugates are administered to a subject in need thereof and home, target, are directed to, are retained by, accumulate in, migrate to, and/or bind to cartilage. The subject is a human or animal and has Joint repair. Upon administration and homing of peptide-icariin conjugates, the Joint repair condition is alleviated.

The peptide can also be a peptide of SEQ ID NO: 592. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or a stable linker as described herein (e.g., EXAMPLES 54 and 55).

Example 88

Peptide-Captopril Conjugates

This example describes conjugation of a peptide of SEQ ID NO: 511 this disclosure to captopril. Captopril is readily conjugated to any peptide disclosed herein via standard chemistries such as those described in, but not limited to, *Bioconjugate Techniques* by Greg Hermanson (Elsevier Inc., 3$^{rd}$ edition, 2013).

The peptide-captopril conjugates are administered to a subject in need thereof and home, target, are directed to, are retained by, accumulate in, migrate to, and/or bind to kidneys. The subject is a human or animal and has diabetic nephropathy. Upon administration and homing of peptide-captopril conjugates, the diabetic nephropathy condition is alleviated.

The peptide can also be a peptide of SEQ ID NO: 508. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 89

Peptide-Tofacitinib Conjugates

This example describes conjugation of a peptide of SEQ ID NO: 592 this disclosure to tofacitinib. Tofacitinib is readily conjugated to any peptide disclosed herein via standard chemistries such as those described in, but not limited to, *Bioconjugate Techniques* by Greg Hermanson (Elsevier Inc., 3$^{rd}$ edition, 2013). From one to eight peptides are linked to tofacitinib.

The peptide-tofacitinib conjugates are administered to a subject in need thereof and home, target, are directed to, are retained by, accumulate in, migrate to, and/or bind to cartilage. The subject is a human or animal and has rheumatoid arthritis and kidney transplant, ankyloses spondylitis. Upon administration and homing of peptide-tofacitinib conjugates, the rheumatoid arthritis and kidney transplant, ankyloses spondylitis condition is alleviated.

The peptide can also be a peptide of SEQ ID NO: 520. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 90

Peptide-Dimethyl fumarate Conjugates

This example describes conjugation of a peptide of SEQ ID NO: 592 this disclosure to dimethyl fumarate. Dimethyl fumarate is readily conjugated to any peptide disclosed herein via standard chemistries such as those described in, but not limited to, *Bioconjugate Techniques* by Greg Hermanson (Elsevier Inc., 3$^{rd}$ edition, 2013). Alternatively, peptide-dimethyl fumarate conjugates can be synthesized by Michael addition of a thiol (on the peptide of linker) to dimethyl fumarate as described by Schmidt et al. (Bioorg Med Chem. 2007 Jan. 1; 15(1):333-42. Epub 2006 Sep. 29.).

The peptide-dimethyl fumarate conjugates are administered to a subject in need thereof and home, target, are directed to, are retained by, accumulate in, migrate to, and/or bind to kidneys. The subject is a human or animal and has Kidney fibrosis, psoriatic arthritis, rheumatoid arthritis. Upon administration and homing of peptide-dimethyl fumarate conjugates, the Kidney fibrosis, psoriatic arthritis, rheumatoid arthritis condition is alleviated.

The peptide can also be a peptide of SEQ ID NO: 671. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 91

Intra-Articular Administration of Peptides and Peptide Conjugates

This example illustrates intra-articular administration of peptides or peptide conjugates of this disclosure. A peptide of this disclosure is expressed recombinantly or chemically synthesized. In some cases, the peptide is subsequently conjugated to a detectable agent or an active agent. The peptide or peptide conjugate is administered to a subject in need thereof via intra-articular administration. The cartilage is penetrated by the peptide or peptide conjugate due to the small size of the peptide or peptide conjugate, and due to binding of cartilage components by the peptide or peptide conjugate. The peptide or peptide conjugate is bound to cartilage and the residence time in the cartilage is longer due to this binding. Optionally, the injected material is aggregated, is crystallized, or complexes are formed, further extending the depot effect and contributing to longer residence time.

The peptide can be a peptide of SEQ ID NO: 592. The peptide can also be a peptide of SEQ ID NO: 508. The peptide can be any peptide with the sequence selected SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 92

Treatment of Osteoarthritis

This example describes a method for treating osteoarthritis using peptides of the present disclosure. This method is used as a treatment for acute and/or chronic symptoms associated with osteoarthritis. A peptide of the present disclosure is expressed recombinantly or chemically synthesized and then is used directly or conjugated to an anti-inflammatory compound, such as aspirin, desciclesonide, or secukinumab. The resulting peptide or peptide-drug conjugate is administered in a pharmaceutical composition subcutaneously, intravenously, or orally, or is injected directly into a joint of a patient and targeted to cartilage. The formulation can be modified physically or chemically to increase the time of exposure in the cartilage. One or more anti-inflammatory peptide conjugates are administered to a human or animal.

The peptide can be a peptide of SEQ ID NO: 590. The peptide can also be a peptide of SEQ ID NO: 517. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 93

Treatment of Cartilage Degradation

This example describes a method for treating and/or preventing cartilage degradation using a peptide of the present disclosure. This method is used as a treatment for acute and/or chronic symptoms associated with cartilage degradation. Progressive degradation or thinning of the cartilage is difficult to treat in part because molecules such as small molecule drugs and antibodies typically do not reach the avascular cartilage. A peptide of the present disclosure is used for its homing and/or native activity, or is mutated to generate activity such as MMP protease inhibition. It is expressed recombinantly or chemically synthesized and then is used directly or conjugated to an extracellular matrix targeting active agent, such as an inhibitor of MMP activity or an anti-apoptosis agent (e.g., osteoprotegrin, romosozumab, P188, ZVAD-fmk, quercetin, dasatinib, dimethyl fumarate, bortezomib, carilzomib, or navitoclax). The resulting peptide or peptide-drug conjugate is administered in a pharmaceutical composition subcutaneously, intravenously, or orally, or is injected directly into a joint of a patient and targeted to extracellular matrix. One or more extracellular matrix targeting conjugates are administered to a human or animal.

The peptide can be a peptide of SEQ ID NO: 671. The peptide can also be a peptide of SEQ ID NO: 511. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 94

Treatment of a Cartilage Injury

This example describes a method for treating a cartilage injury using a peptide of the present disclosure. A peptide of the present disclosure is expressed recombinantly or chemically synthesized and then is used directly or conjugated to a therapeutic compound, such as those described herein, including, but not limited to BMP-2, BMP-7, BMP-9, BMP-13, PDGF, PTH, PTHrP, IL-8, MIP-3a. The resulting peptide or peptide-drug conjugate is administered in a pharmaceutical composition to a patient and targeted to cartilage. One or more therapeutic compound-peptide conjugates are administered to a human or animal.

The peptide can be a peptide of SEQ ID NO: 592. The peptide can also be a peptide of SEQ ID NO: 669. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 95

Treatment of Rheumatoid Arthritis

This example describes a method for treating rheumatoid arthritis. This method is used as a treatment for acute and/or chronic symptoms associated with rheumatoid arthritis. A peptide of the present disclosure is expressed recombinantly or chemically synthesized and then is used directly, or is conjugated to an anti-inflammatory compound, such as adalimumab, certolizumab, golimumab, thalidomide, lenalidomide, pomalidomide, pentocifylline, bupropion. When the peptide is used directly, the peptide can, for example, bind or inhibit ion channels such as Kv 1. 3. The resulting peptide or peptide-drug conjugate is administered in a pharmaceutical composition to a patient and is targeted to cartilage. One or more anti-inflammatory compound-peptide conjugates are administered to a human or animal subcutaneously, intravenously, or orally, or is injected directly into a joint The peptide can be a peptide of SEQ ID NO: 590. The peptide can also be a peptide of SEQ ID NO: 509. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 96

Treatment of Gout

This example describes a method for treating gout using peptides of the present disclosure. This method is used as a treatment for acute and/or chronic symptoms associated with gout. A peptide of the present disclosure is expressed and administered in a pharmaceutical composition to a patient as a therapeutic for gout. A peptide of the disclosure is recombinantly or chemically synthesized and then is used directly or conjugated to pegloticase to treat a cartilage disorder. A peptide of the disclosure is recombinantly or chemically synthesized and then is used directly or conjugated to probenecid to treat a kidney disorder. The peptide is administered in a pharmaceutical composition to a patient and the peptide is targeted to the cartilage or kidney affected by gout. One or more peptides are administered to a human or animal subcutaneously, intravenously, or orally, or is injected directly into a joint.

The peptide can be a peptide of SEQ ID NO: 671. The peptide can also be a peptide of SEQ ID NO: 508. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 97

Treatment or Management of Pain

This example describes a method for treating or managing pain associated with a cartilage injury or disorder. This method is used as a treatment for acute and/or chronic symptoms associated with a cartilage injury or disorder. A peptide of the disclosure is expressed and administered in a pharmaceutical composition to a patient as a therapeutic for pain as a result of injury or other cartilage or joint condition as described herein. The peptide of the present disclosure inhibits ion channels, such as Nav 1.7. The peptide is expressed recombinantly or chemically synthesized, wherein the peptide selected from SEQ ID NO: 508-SEQ ID NO: 758 or SEQ ID NO: 798-SEQ ID NO: 1048. Alternatively, the peptides of SEQ ID NO: 508-SEQ ID NO: 758 or SEQ ID NO: 798-SEQ ID NO: 1048 are mutated to maintain the cartilage homing function, but to add or increase ion channel inhibition, such as to Nav 1. 7. Following expression or synthesis, the peptide is used directly or conjugated to a narcotic (e.g., oxycodone), a non-narcotic analgesic, a natural counter-irritant (capsaicin), or a pain receptor channel inhibitor (such as the TRPV4 inhibitor GSK2193874). Following administration of the peptide, the peptide targets to the cartilage affected by pain. One or more peptides are administered to a human or animal subcutaneously, intravenously, or orally, or is injected directly into a joint.

The peptide can be a peptide of SEQ ID NO: 592. The peptide can also be a peptide of SEQ ID NO: 591. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 98

Treatment or Management of Pain with Peptides Only

This example describes a method for treating or managing pain associated with a cartilage injury or disorder. This method is used as a treatment for acute and/or chronic symptoms associated with a cartilage injury or disorder. A peptide of the disclosure is expressed and administered in a pharmaceutical composition to a patient as a therapeutic for pain as a result of injury or other cartilage or joint condition as described herein. The peptide of the present disclosure inhibits ion channels, such as Nav 1.7. The peptide is expressed recombinantly or chemically synthesized, wherein the peptide selected from SEQ ID NO: 508-SEQ ID NO: 758 or SEQ ID NO: 798-SEQ ID NO: 1048. Alternatively, the peptides of SEQ ID NO: 508-SEQ ID NO: 758 or SEQ ID NO: 798-SEQ ID NO: 1048 are mutated to maintain the cartilage homing function, but to add or increase ion channel inhibition, such as to Nav 1.7. Following expression or synthesis, the peptide is used directly. Following administration of the peptide, the peptide targets to the cartilage affected by pain. One or more peptides are administered to a human or animal subcutaneously, intravenously, or orally, or is injected directly into a joint.

The peptide can be a peptide of SEQ ID NO: 592. The peptide can also be a peptide of SEQ ID NO: 591. The peptide can be any peptide with the sequence selected from SEQ ID NO: 508-SEQ ID NO: 758 or SEQ ID NO: 798-SEQ ID NO: 1048.

Example 99

Treatment of Chondrosarcoma

This example illustrates treatment of chondrosarcoma using peptides of the present disclosure. A peptide of the present disclosure is recombinantly expressed or chemically synthesized and are used directly, after radiolabeling, or after conjugation to a fluorophore or therapeutic compound, such as dasatinib. The peptide or peptide conjugate is administered in a pharmaceutical composition to a subject as a therapeutic for chondrosarcoma. One or more peptides or peptide conjugates of the present disclosure are administered to a subject. A subject can be a human or an animal. The pharmaceutical composition is administered subcutaneously, intravenously, orally, or injected directly into a joint. The peptides or peptide conjugates target cartilage affected by chondrosarcoma.

The peptide can be a peptide of SEQ ID NO: 590. The peptide can also be a peptide of SEQ ID NO: 592. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 100

Treatment of Chordoma

This example illustrates treatment of chordoma using peptides of the present disclosure. A peptide of the present disclosure is recombinantly expressed or chemically synthesized and are used directly, after radiolabeling, or after conjugation to a fluorophore or therapeutic compound, such as dasatinib. The peptide or peptide conjugate is administered in a pharmaceutical composition to a subject as a therapeutic for chordoma. One or more peptides or peptide conjugates of the present disclosure are administered to a subject. A subject can be a human or an animal. The pharmaceutical composition is administered subcutaneously, intravenously, orally, or injected directly into a joint. The peptides or peptide conjugates target cartilage affected by chordoma.

The peptide can be a peptide of SEQ ID NO: 671. The peptide can also be a peptide of SEQ ID NO: 508. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 101

Treatment for Rapid Pain Relief

This example illustrates rapid pain relief in patients treated for rheumatoid arthritis or osteoarthritis with the peptides or peptide conjugates of this disclosure. A peptide of this disclosure is expressed recombinantly or chemically synthesized, and then the N-terminus of the peptide is conjugated to an active agent via an NHS ester to produce a peptide-active agent conjugate. In some aspects the active agent such as a kidney therapeutic from TABLE 54, TABLE 55, or TABLE 56. In some cases, the peptide alone is administered to the subject.

The peptide or peptide-active agent conjugate is administered to a subject in need thereof. The subject is a human or non-human animal. The subject in need thereof has rheumatoid arthritis or osteoarthritis. The peptide or peptide conjugate is delivered via intravenous administration. Upon administration, the peptide or peptide conjugate rapidly homes to cartilage. Rapid pain relief within five minutes to an hour is experienced by the subject, and pain relieve can last as long as over 3 hours.

The peptide can be a peptide of SEQ ID NO: 592. The peptide can also be a peptide of SEQ ID NO: 517. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 102

Treatment for Lupus Nephritis

This example illustrates treatment of lupus nephritis using peptides or peptide conjugates of this disclosure. A peptide of the present disclosure is recombinantly expressed or chemically synthesized and are used directly, after radiolabeling, or after conjugation to a fluorophore or therapeutic compound, such as abatacept or BIIB023.

The peptide or peptide conjugate is administered in a pharmaceutical composition to a subject as a therapeutic for lupus nephritis. The peptide is selected from any one of the peptides of SEQ ID NO: 508-SEQ ID NO: 758 or SEQ ID NO: 798-SEQ ID NO: 1048. One or more peptides or peptide conjugates of the present disclosure are administered to a subject. A subject can be a human or an animal. The pharmaceutical composition is administered subcutaneously, intravenously, orally, or injected directly. The peptides or peptide conjugates target kidney affected by lupus nephritis.

The peptide can be a peptide of SEQ ID NO: 511. The peptide can also be a peptide of SEQ ID NO: 508. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 103

Treatment for Acute Kidney Injury (AKI)

This example illustrates treatment of acute kidney injury (AKI) using peptides or peptide conjugates of this disclosure. A peptide of the present disclosure is recombinantly expressed or chemically synthesized and are used directly, after radiolabeling, or after conjugation to a fluorophore or therapeutic compound, such as such as a kidney therapeutic from TABLE 54, TABLE 55, or TABLE 56.

The peptide or peptide conjugate is administered in a pharmaceutical composition to a subject as a therapeutic for acute kidney injury (AKI). The peptide is selected from any one of the peptides of SEQ ID NO: 508-SEQ ID NO: 758 or SEQ ID NO: 798-SEQ ID NO: 1048. One or more peptides or peptide conjugates of the present disclosure are administered to a subject. A subject can be a human or an animal. The pharmaceutical composition is administered subcutaneously, intravenously, orally, or injected directly into a joint. The peptides or peptide conjugates target cartilage affected by acute kidney injury (AKI).

The peptide can be a peptide of SEQ ID NO: 592. The peptide can also be a peptide of SEQ ID NO: 520. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 104

Treatment for Chronic Kidney Disease (CKD)

This example illustrates treatment of chronic kidney disease (CKD) using peptides or peptide conjugates of this disclosure. A peptide of the present disclosure is recombinantly expressed or chemically synthesized and are used directly, after radiolabeling, or after conjugation to a fluorophore or therapeutic compound, such as a kidney therapeutic from TABLE 54, TABLE 55, or TABLE 56.

The peptide or peptide conjugate is administered in a pharmaceutical composition to a subject as a therapeutic for chronic kidney disease (CKD). The peptide is selected from any one of the peptides of SEQ ID NO: 508-SEQ ID NO: 758 or SEQ ID NO: 798-SEQ ID NO: 1048. One or more peptides or peptide conjugates of the present disclosure are administered to a subject. A subject can be a human or an animal. The pharmaceutical composition is administered subcutaneously, intravenously, orally, or injected directly into a joint. The peptides or peptide conjugates target cartilage affected by chronic kidney disease (CKD).

The peptide can be a peptide of SEQ ID NO: 683. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 105

Treatment for Hypertensive Kidney Damage

This example illustrates treatment of hypertensive kidney damage using peptides or peptide conjugates of this disclosure. A peptide of the present disclosure is recombinantly expressed or chemically synthesized and are used directly, after radiolabeling, or after conjugation to a fluorophore or therapeutic compound, such as such as a kidney therapeutic from TABLE 54, TABLE 55, or TABLE 56.

The peptide or peptide conjugate is administered in a pharmaceutical composition to a subject as a therapeutic for hypertensive kidney damage. The peptide is selected from any one of the peptides of SEQ ID NO: 508-SEQ ID NO: 758 or SEQ ID NO: 798-SEQ ID NO: 1048. One or more peptides or peptide conjugates of the present disclosure are administered to a subject. A subject can be a human or an animal. The pharmaceutical composition is administered subcutaneously, intravenously, orally, or injected directly into a joint. The peptides or peptide conjugates target cartilage affected by hypertensive kidney damage.

The peptide can be a peptide of SEQ ID NO: 511. The peptide can also be a peptide of SEQ ID NO: 669. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 106

Treatment for Diabetic Nephropathy

This example illustrates treatment of diabetic nephropathy using peptides or peptide conjugates of this disclosure.

A peptide of the present disclosure is recombinantly expressed or chemically synthesized and are used directly, after radiolabeling, or after conjugation to a fluorophore or therapeutic compound, such as such as a kidney therapeutic from TABLE 54, TABLE 55, or TABLE 56.

The peptide or peptide conjugate is administered in a pharmaceutical composition to a subject as a therapeutic for diabetic nephropathy. The peptide is selected from any one of the peptides of SEQ ID NO: 508-SEQ ID NO: 758 or SEQ ID NO: 798-SEQ ID NO: 1048. One or more peptides or peptide conjugates of the present disclosure are administered to a subject. A subject can be a human or an animal. The pharmaceutical composition is administered subcutaneously, intravenously, orally, or injected directly into a joint. The peptides or peptide conjugates target cartilage affected by diabetic nephropathy.

The peptide can be a peptide of SEQ ID NO: 592. The peptide can also be a peptide of SEQ ID NO: 506. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 107

Treatment for Renal Fibrosis

This example illustrates treatment of renal fibrosis using peptides or peptide conjugates of this disclosure. A peptide of the present disclosure is recombinantly expressed or chemically synthesized and are used directly, after radiolabeling, or after conjugation to a fluorophore or therapeutic compound, such as such as a kidney therapeutic from TABLE 54, TABLE 55, or TABLE 56.

The peptide or peptide conjugate is administered in a pharmaceutical composition to a subject as a therapeutic for renal fibrosis. The peptide is selected from any one of the peptides of SEQ ID NO: 508-SEQ ID NO: 758 or SEQ ID NO: 798-SEQ ID NO: 1048. One or more peptides or peptide conjugates of the present disclosure are administered to a subject. A subject can be a human or an animal. The pharmaceutical composition is administered subcutaneously, intravenously, orally, or injected directly into a joint. The peptides or peptide conjugates target cartilage affected by renal fibrosis.

The peptide can be a peptide of SEQ ID NO: 683. The peptide can also be a peptide of SEQ ID NO: 510. The peptide can be any peptide with the sequence selected from SEQ ID NO: 508-SEQ ID NO: 758 or SEQ ID NO: 798-SEQ ID NO: 1048. Such peptide-drug conjugates can be made using either a cleavable or stable linker as described herein (e.g., EXAMPLES 54 and 55).

Example 108

Peptide Variants Based on Multiple Sequence Alignment

This example illustrates using multiple sequence alignment to design peptide variants with increased stability and decreased immunogenicity. An alignment was generated using R language and an "msa" software package, which codes for R language specific for multiple alignments (Bodenhofer, U et al. *Bioinformatics*, 31 (24): 3997-3999 (2015)). FIG. 44 illustrates a multiple sequence alignment of SEQ ID NO: 800, SEQ ID NO: 801, SEQ ID NO: 805, SEQ ID NO: 817, SEQ ID NO: 821, SEQ ID NO: 822, SEQ ID NO: 824, SEQ ID NO: 882, SEQ ID NO: 958, SEQ ID NO: 967, SEQ ID NO: 970, and SEQ ID NO: 1027-SEQ ID NO: 1033. The alignment identified permissive or preferred amino acids at a given location, and provided a guide for discovery of novel peptide variants that could be generated and that could retain essential properties such as structure, function, peptide folding, biodistribution, or stability. SEQ ID NO: 505 and SEQ ID NO: 779 are consensus sequences based on the above multiple sequence alignment. SEQ ID NO: 505 is the same sequence as SEQ ID NO: 779 but with an N-terminal "GS." Furthermore, based on the ability to substitute K residues to R residues, the multiple sequence alignment identified peptides of the family of sequences of SEQ ID NO: 506 and SEQ ID NO: 780 as potential peptide variants that could be generated and that could retain essential properties such as structure, function, peptide folding, biodistribution, or stability. Additionally, the multiple sequence alignment identified SEQ ID NO: 796 as a conserved region within the sequences of the alignment, which may, at least in part, be important for maintaining the essential properties such as structure, function, peptide folding, biodistribution, binding, accumulation, retention, or stability.

Example 109

Peptide Immunogenicity

This example illustrates the testing of the immunogenicity of a peptide. NetMHC II version 2.3 prediction software was used to identify immunogenic peptides based on a neural network alignment algorithm that predicts peptide binding to MHC Class II molecules. The NetMHC II prediction software was utilized to determine the putative peptide binding capability to DR, DQ, and DP MHC II alleles and the strength of the interaction between peptide and MHC II molecules. TABLE 57 shows the resulting immunogenicity score of select peptides. The numbers of strong versus weak peptides were tallied into each major MHC allele group (DR, DQ, and DP). Additionally, the numbers of 'unique strong' and 'unique weak core' peptides were also tallied. These data were used to predict which peptides are less likely to induce an immunogenic response in patients. For example, the stronger a peptide binds to an allele, the more likely it is to be presented in a MHC/peptide combination on an antigen presenting cell, thus triggering an immune response, and a peptide that is predicted to bind to fewer alleles is more likely to have weaker binding to given alleles and should be less immunogenic.

TABLE 57

Immunogenicity Scores of Peptides

| SEQ ID NO: | Strong Binding Alleles (DR + DQ + DP) | Unique Strong Core Peptides | Weak Binding Alleles (DR + DQ + DP) | Unique Weak Core Peptides |
|---|---|---|---|---|
| SEQ ID NO: 592 | 1 + 0 + 0 | 1 + 0 + 0 | 7 + 1 + 0 | 7 + 2 + 0 |
| SEQ ID NO: 744 | 0 + 0 + 0 | 0 + 0 + 0 | 4 + 1 + 3 | 6 + 1 + 1 |
| SEQ ID NO: 745 | 0 + 0 + 0 | 0 + 0 + 0 | 4 + 1 + 3 | 6 + 2 + 1 |
| SEQ ID NO: 746 | 1 + 0 + 0 | 2 + 0 + 0 | 5 + 1 + 3 | 7 + 1 + 1 |
| SEQ ID NO: 747 | 1 + 0 + 0 | 2 + 0 + 0 | 6 + 1 + 3 | 5 + 1 + 1 |
| SEQ ID NO: 748 | 0 + 0 + 0 | 0 + 0 + 0 | 4 + 1 + 3 | 6 + 2 + 1 |
| SEQ ID NO: 749 | 0 + 0 + 0 | 0 + 0 + 0 | 5 + 1 + 3 | 7 + 2 + 1 |
| SEQ ID NO: 755 | 0 + 0 + 1 | 0 + 0 + 1 | 7 + 4 + 1 | 8 + 6 + 2 |
| SEQ ID NO: 758 | 0 + 0 + 0 | 0 + 0 + 0 | 5 + 4 + 1 | 5 + 4 + 2 |
| SEQ ID NO: 882 | 1 + 0 + 0 | 1 + 0 + 0 | 7 + 1 + 0 | 7 + 1 + 0 |
| SEQ ID NO: 1034 | 0 + 0 + 0 | 0 + 0 + 0 | 4 + 0 + 3 | 6 + 0 + 1 |
| SEQ ID NO: 1035 | 0 + 0 + 0 | 0 + 0 + 0 | 4 + 1 + 3 | 6 + 1 + 1 |
| SEQ ID NO: 1036 | 1 + 0 + 0 | 2 + 0 + 0 | 5 + 0 + 3 | 7 + 0 + 1 |
| SEQ ID NO: 1037 | 1 + 0 + 0 | 2 + 0 + 0 | 6 + 0 + 3 | 5 + 0 + 1 |
| SEQ ID NO: 1038 | 0 + 0 + 0 | 0 + 0 + 0 | 4 + 1 + 3 | 6 + 1 + 1 |
| SEQ ID NO: 1039 | 0 + 0 + 0 | 0 + 0 + 0 | 5 + 1 + 3 | 7 + 1 + 1 |
| SEQ ID NO: 1045 | 0 + 0 + 1 | 0 + 0 + 1 | 7 + 4 + 1 | 8 + 6 + 2 |
| SEQ ID NO: 1048 | 0 + 0 + 0 | 0 + 0 + 0 | 5 + 4 + 1 | 5 + 5 + 2 |

Example 110

Peptide Variants

This example illustrates the design of variant peptide sequences with increased stability, decreased regions of immunogenicity, and the substitution of a tyrosine for spectrophotometric reporting as compared to a parent peptide sequence. Potential mutations to the parent peptide sequence, SEQ ID NO: 592, that may result in a peptide with increased stability, decreased immunogenicity, or increased absorbance at 270-280 nm (such as the substitution to a tyrosine or tryptophan residue for spectrophotometric reporting) were identified based on information from multiple sequence alignment from EXAMPLE 108 and immunogenicity testing from EXAMPLE 109.

In SEQ ID NO: 592, residue N7 is at risk for deamidation. Based on the multiple sequence alignment of SEQ ID NO: 800, SEQ ID NO: 801, SEQ ID NO: 805, SEQ ID NO: 817, SEQ ID NO: 821, SEQ ID NO: 822, SEQ ID NO: 824, SEQ ID NO: 882, SEQ ID NO: 967, SEQ ID NO: 970, and SEQ ID NO: 1027-SEQ ID NO: 1033, the candidate residue mutations to best reduce this risk were N7S and N7G. N7S was determined to be more likely to result in a peptide with desirable properties such as folding and stability as shown by matches in the alignment and conservationist presence in a peptide with high stability (SEQ ID NO: 958).

Residue D18 is at risk for cleavage. Based on the multiple sequence alignment, the candidate residue mutations to best reduce cleavage at D18 are D18E and D18Q. D18E is the preferred choice based on retaining charge.

Residue M25 is at risk for oxidation. Based on the multiple sequence alignment, the candidate residue mutations to best reduce oxidation were M25T and M25A. Based on the immunogenicity score of peptides with each mutation, it was determined that M25T is the better mutation, as it eliminates a significant source of immunogenicity as compared to SEQ ID NO: 592 as well as the variant with M25A, which did not eliminate the predicted immunogenicity of the parent peptide of SEQ ID NO: 592.

Residue N32 is at risk for deamidation, at least in part due to the neighboring residue S33. However, N32 is conserved across Kv1.3 binding cystine-dense peptides in the alignment of EXAMPLE 108, and implicated in receptor binding (Peigneur, S., Biochemistry, 55(32): 2927-35 (2016)). For certain applications, peptides are designed to maintain this binding interaction, and for other applications, peptides are designed to remove this binding interaction. To maintain functionality, one candidate residue mutation based on the multiple sequence alignment is S33R, which would impact deamidation. However, it resulted in a predicted increased immunogenicity score. Another candidate residue mutation is S33G, but this may result in higher deamidation rates. If N32 is mutated, the best candidate residue mutation based the multiple sequence alignment in combination with the immunogenicity score was N32Q despite it having a slight increase in immunogenicity. Other options are N32A, N32S, or N32T. Alternatively, to remove functionality, candidate mutations based on the multiple sequence alignment are N32A and N32L, which are the preferred choices.

For the substitution to a tyrosine for spectrophotometric reporting, the best candidate locations were T38Y (which had the strongest precedence in the multiple sequence alignment and is found in several of the stable peptides (e.g., SEQ ID NO: 958, SEQ ID NO: 1028, and SEQ ID NO: 1029)), L17Y, and H36Y. However, T38Y may slightly increase immunogenicity with respect to the DR allele. Another option for spectrophometric absorbance is to substitute Trp for the Leu at position 17.

Based on the above analysis, the following short list of potential mutations for SEQ ID NO: 592 were compiled: N7S; D18E; M25T; N32Q, N32A, N32S, N32T, N32L, S33G, and S33R (variants both to retain function and to remove function of binding ion channel); and L17Y, H36Y, and T38Y.

TABLE 58 provides some exemplary sequences using various combinations of these mutations.

TABLE 58

Exemplary Sequence Variants of SEQ ID NO: 592

| SEQ ID NO: | Mutations |
|---|---|
| SEQ ID NO: 592 | Parent |
| SEQ ID NO: 1034 | N55, D16E, M23T, S31G |
| SEQ ID NO: 1035 | N55, D16E, M23T, N30Q |

TABLE 58-continued

Exemplary Sequence Variants of SEQ ID NO: 592

| SEQ ID NO: | Mutations |
|---|---|
| SEQ ID NO: 1036 | N55, D16E, M23T, 531R |
| SEQ ID NO: 1037 | D16E, M23T |
| SEQ ID NO: 1038 | D16E, M23T, N30Q |
| SEQ ID NO: 1039 | D16E, M23T, N30Q, T36Y |
| SEQ ID NO: 1040 | L15Y, D16E, M23T, N30Q |
| SEQ ID NO: 1041 | D16E, M23T, N30Q, H34Y |
| SEQ ID NO: 1042 | N55, D16E, M23T, N30Q, T36Y |
| SEQ ID NO: 1043 | N55, L15Y, D16E, M23T, N30Q |
| SEQ ID NO: 1044 | N55, D16E, M23T, N30Q, H34Y |
| SEQ ID NO: 1045 | D16E, M23T, N32A, T36Y |
| SEQ ID NO: 1046 | D16E, M23T, N32S, T36Y |
| SEQ ID NO: 1047 | D16E, M23T, N32T, T36Y |
| SEQ ID NO: 1048 | D16E, M23T, T36Y |

Example 111

Peptide-Budesonide Conjugate

This example describes conjugation of a peptide of any one of SEQ ID NO: 744-SEQ ID NO: 758 or SEQ ID NO: 1034-SEQ ID NO: 1048 to budesonide. Budesonide is readily conjugated to any peptide disclosed herein via standard chemistries such as those described in, but not limited to, *Bioconjugate Techniques* by Greg Hermanson (Elsevier Inc., 3$^{rd}$ edition, 2013) or by any of the methods described in EXAMPLES 58-61.

The peptide-budesonide conjugates are administered to a subject in need thereof and home, target, are directed to, are retained by, accumulate in, migrate to, and/or bind to cartilage and/or kidneys. The subject is a human or animal and has inflammation in the cartilage or kidney tissues. Upon administration and homing of peptide-budesonide conjugates, the inflammation in the cartilage and/or kidney tissues is alleviated.

Example 112

Peptide-Dexamethasone Conjugate

This example describes conjugation of a peptide of any one of SEQ ID NO: 744-SEQ ID NO: 758 or SEQ ID NO: 1034-SEQ ID NO: 1048 to dexamethasone. Dexamethasone is readily conjugated to any peptide disclosed herein via standard chemistries such as those described in, but not limited to, *Bioconjugate Techniques* by Greg Hermanson (Elsevier Inc., 3$^{rd}$ edition, 2013) or by any of the methods described in EXAMPLES 58-61.

The peptide-dexamethasone conjugates are administered to a subject in need thereof and home, target, are directed to, are retained by, accumulate in, migrate to, and/or bind to cartilage and/or kidneys. The subject is a human or animal and has inflammation in the cartilage or kidney tissues. Upon administration and homing of peptide-dexamethasone conjugates, the inflammation in the cartilage and/or kidney tissues is alleviated.

Example 113

Peptide-Triamcinolone Acetonide Conjugate

This example describes conjugation of a peptide of any one of SEQ ID NO: 744-SEQ ID NO: 758 or SEQ ID NO: 1034-SEQ ID NO: 1048 to triamcinolone acetonide. Triamcinolone acetonide is readily conjugated to any peptide disclosed herein via standard chemistries such as those described in, but not limited to, *Bioconjugate Techniques* by Greg Hermanson (Elsevier Inc., 3$^{rd}$ edition, 2013 or by any of the methods described in EXAMPLES 58-61.

The peptide-triamcinolone acetonide conjugates are administered to a subject in need thereof and home, target, are directed to, are retained by, accumulate in, migrate to, and/or bind to cartilage and/or kidneys. The subject is a human or animal and has inflammation in the cartilage or kidney tissues. Upon administration and homing of peptide-triamcinolone acetonide conjugates, the inflammation in the cartilage and/or kidney tissues is alleviated.

Example 114

Peptide-Desciclesonide Acetonide Conjugate

This example describes conjugation of a peptide of any one of SEQ ID NO: 744-SEQ ID NO: 758 or SEQ ID NO: 1034-SEQ ID NO: 1048 to desciclesonide acetonide. Desciclesonide acetonide is readily conjugated to any peptide disclosed herein via standard chemistries such as those described in, but not limited to, *Bioconjugate Techniques* by Greg Hermanson (Elsevier Inc., 3$^{rd}$ edition, 2013) or by any of the methods described in EXAMPLES 58-61.

The peptide-desciclesonide acetonide conjugates are administered to a subject in need thereof and home, target, are directed to, are retained by, accumulate in, migrate to, and/or bind to cartilage and/or kidneys. The subject is a human or animal and has inflammation in the cartilage or kidney tissues. Upon administration and homing of peptide-desciclesonide acetonide conjugates, the inflammation in the cartilage and/or kidney tissues is alleviated.

Example 115

Method of Peptide Synthesis

This example describes the synthesis of SEQ ID NO: 590, SEQ ID NO: 592, and SEQ ID NO: 671.

A peptide of SEQ ID NO: 592 was made using Solid Phase Peptide Synthesis (SPPS). After release of the peptide from the solid phase, the peptide was purified prior to folding by oxidation in solution. The folded peptide was further purified by reversed-phase chromatography and lyophilized as a TFA salt. The final SEQ ID NO: 592 peptide product had a purity of 96.1% and a mass of 4,301.7 Da, which confirmed its identity as a peptide of SEQ ID NO: 592.

A peptide of SEQ ID NO: 590 was made using Solid Phase Peptide Synthesis (SPPS). After release of the peptide from the solid phase, the peptide was folded by oxidation in solution. The folded peptide was purified by reversed-phase chromatography and lyophilized as a TFA salt. The final SEQ ID NO: 590 had a purity of 95.6% and a mass of 4,503.0 Da, which confirmed its identity as a peptide of SEQ ID NO: 590.

A peptide of SEQ ID NO: 671 was made using Solid Phase Peptide Synthesis (SPPS). After release of the peptide from the solid phase, the peptide was folded by oxidation in solution. The folded peptide was purified by reversed-phase chromatography and lyophilized as a TFA salt. The final SEQ ID NO: 671 peptide product had a purity of 95.5% and a mass of 4,154.0 Da, which confirmed its identity as a peptide of SEQ ID NO: 671.

Example 117

Whole Body Autoradiography of Cartilage Homing Peptides

This example illustrates peptide homing to cartilage mice 5 minutes to 48 hours after administration of a radiolabeled peptide. Signal from the radiolabeled peptides was found in all types of cartilage at each time point examined. Each peptide was radiolabeled by methylating lysines at the N-terminus as described in EXAMPLE 35. As such, the peptide may contain methyl or dimethyl lysines and a methylated or dimethlyated amino terminus. A dose of 100 nmol radiolabeled peptide was administered via tail vein injection in Female Harlan athymic nude mice, weighing 20-25 g. The experiment was done in duplicate (n=2 animals per group). Each radiolabeled peptide was allowed to freely circulate within the animal for the described time period before the animals were euthanized and sectioned.

Whole body autoradiography (WBA) sagittal sectioning was performed as follows. At the end of the dosing period, mice were frozen in a hexane/dry ice bath and then embedded in a frozen block of carboxymethylcellulose. Whole animal sagittal slices were prepared that resulted in thin frozen sections for imaging. Sections were allowed to dessicate in a freezer prior to imaging. For the autoradiography imaging, tape mounted thin sections were freeze dried and radioactive samples were exposed to phosphoimager plates. These plates were developed and the signal (densitometry) from each organ was normalized to the signal found in the cardiac blood of each animal. A signal in tissue darker than the signal expected from blood in that tissue indicates accumulation in a region, tissue, structure, or cell.

Figure 47A:
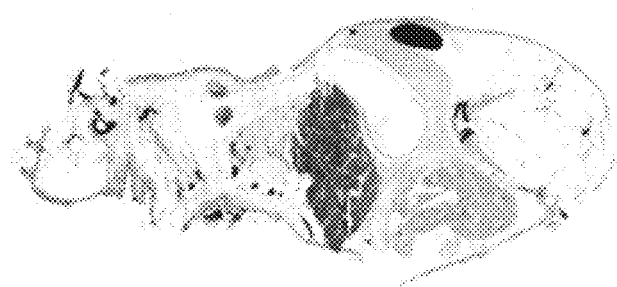
FIG. 47A-FIG. 47B illustrates autoradiography images of frozen sections from a mouse, 3 hours after administration of 100 nmol of a radiolabeled peptide of SEQ ID NO: 592.
Figure 47B:
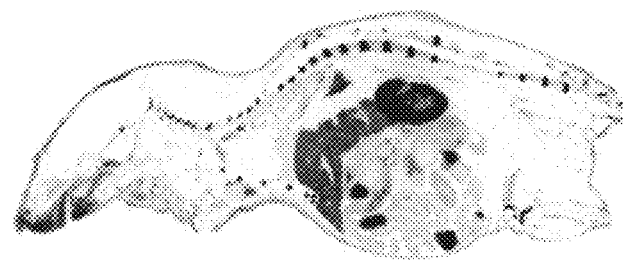

FIG. 47A-FIG. 47B illustrates autoradiography image of frozen sections from a mouse, 3 hours after administration of 100 nmol of a radiolabeled peptide of SEQ ID NO: 592. FIG. 47A illustrates the $^{14}C$ signal in a frozen section of a mouse, 3 hours after administration of 100 nmol of a radiolabeled peptide of SEQ ID NO: 592. The $^{14}C$ signal identifies the radiolabeled peptide distribution in the cartilage of the mouse. FIG. 47B illustrates the $^{14}C$ signal in a different frozen section of a mouse, 3 hours after administration of 100 nmol of a radiolabeled peptide of SEQ ID NO: 592. The $^{14}C$ signal identifies the radiolabeled peptide distribution in the cartilage of the mouse.

TABLE 59 shows the signal of radiolabeled peptides of SEQ ID NO: 511 and SEQ ID NO: 592 in intervertebral discs (IVD) and knee joints as a percentage of the blood. Because the peptides may arrive at the joint within five minutes, a therapeutic effect from the peptide or a conjugated active agent may begin quickly. A therapeutic effect could be long lasting, due to continued presence of detected agents at 48 hours and/or due to long lasting pharmacodynamics effects.

TABLE 59

Signal of Radiolabeled Peptides of SEQ ID NO: 511 and SEQ ID NO: 592 in IVD and Knee Joints as a Percentage of Blood

| Hours | SEQ ID NO: 511 IVD | SEQ ID NO: 592 IVD | SEQ ID NO: 592 Knee |
|---|---|---|---|
| 0.08 | | 164 | 404 |
| 0.5 | | 369 | 510 |
| 1 | | 961 | 1114 |
| 3 | 1779 | 3213 | 4059 |
| 8 | | 3777 | 4990 |
| 24 | 833 | 5391 | 2137 |
| 48 | | 3320 | 843 |

Figure 48A:
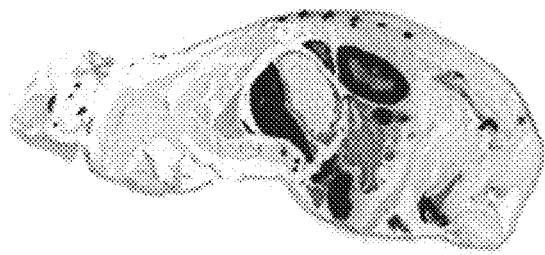
FIG. 48A-FIG. 48B illustrates autoradiography images of frozen sections from a mouse, 3 hours after administration of 100 nmol of a radiolabeled peptide of SEQ ID NO: 590.
Figure 48B:
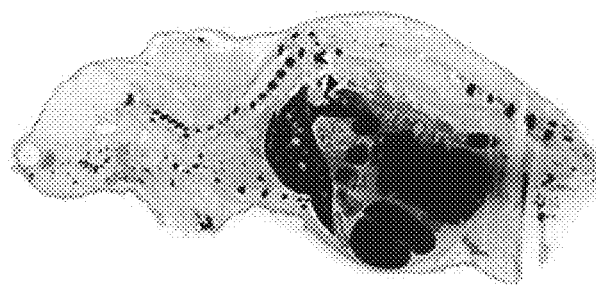

FIG. 48A-FIG. 48B illustrates autoradiography images of frozen sections from a mouse, 3 hours after administration of 100 nmol of a radiolabeled peptide of SEQ ID NO: 590. FIG. 48A illustrates the $^{14}C$ signal in a frozen section of a mouse, 3 hours after administration of 100 nmol of a radiolabeled peptide of SEQ ID NO: 590. The $^{14}C$ signal identifies the radiolabeled peptide distribution in the cartilage of the mouse. FIG. 48B illustrates the $^{14}C$ signal in a frozen section of a different mouse, 3 hours after administration of 100 nmol of a radiolabeled peptide of SEQ ID NO: 590. The $^{14}C$ signal identifies the radiolabeled peptide distribution in the cartilage of the mouse.

Figure 49A:
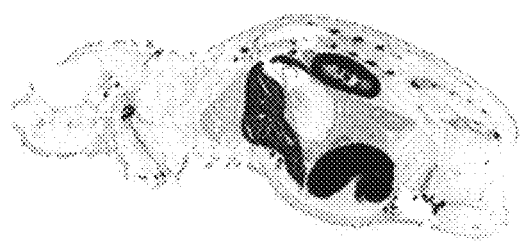
FIG. 49A-FIG. 49B illustrates autoradiography images of frozen sections from a mouse, 3 hours after administration of 100 nmol of a radiolabeled peptide of SEQ ID NO: 671.
Figure 49B:
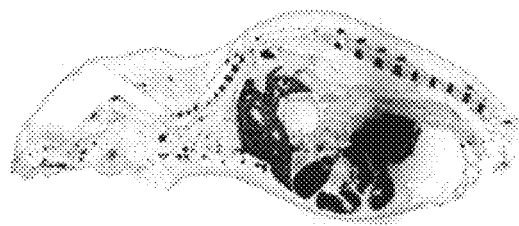

FIG. 49A-FIG. 49B illustrates autoradiography images of frozen sections from a mouse, 3 hours after administration of 100 nmol of a radiolabeled peptide of SEQ ID NO: 671. FIG. 49A illustrates the $^{14}C$ signal in a frozen section of the mouse, 3 hours after administration of 100 nmol of a radiolabeled peptide of SEQ ID NO: 671. The $^{14}C$ signal identifies the radiolabeled peptide distribution in the cartilage of the mouse. FIG. 49B illustrates the $^{14}C$ signal in a frozen section of a different mouse, 3 hours after administration of 100 nmol of a radiolabeled peptide of SEQ ID NO: 671. The $^{14}C$ signal identifies the radiolabeled peptide distribution in the cartilage of the mouse.

This data illustrates peptides of SEQ ID NO: 511, SEQ ID NO: 592, SEQ ID NO: 590 and SEQ ID NO: 671 homed to and accumulated in the cartilage of the animals. The peptide of SEQ ID NO: 592 is a K to R variant of a peptide of SEQ ID NO: 511. These data show that K to R variants of cartilage homing peptides retained their cartilage homing properties.

SEQ ID NO: 1051 (GSGVPINVRSRGSRDSLDPSR-RAGMRFGRSINSRSHSTP) is a linearized version of SEQ ID NO: 592, where the knotted scaffold of the peptide was removed by mutating out the cysteine residues that form the disulfide bonds of the peptide to serine residues, but retaining the rest of the sequence. TABLE 60 shows quantification of signal as a percentage of signal in blood from a linearized radiolabeled SEQ ID NO: 1051 peptide in intervertebral discs (IVD).

Signal of Radiolabled Peptides of SEQ ID NO: 1051 in IVD as a Percentage of Blood

| | 3 hr Ligated Kidneys | 3 hr Intact Kidneys | 24 hr Intact Kidneys |
|---|---|---|---|
| IVD | 117 | 177 | 104 |

The peptide of SEQ ID NO: 1051, a linearized version of the peptide of SEQ ID NO: 592, homed to cartilage to a much lesser extent than the folded knotted peptide (SEQ ID NO: 592). The signal of the folded knotted peptide of SEQ ID NO: 592 was ~20-fold greater at 3 hours and ~50-fold greater at 24 hours (TABLE 59) as compared to the linearized peptide of SEQ ID NO: 1051 (TABLE 60). These results indicate that in addition to changes in primary sequence or peptide charge, homing to cartilage can also be related to changes in conformation, or tertiary structure. Namely, in some cases, folded cystine-dense peptides can be exemplary cartilage homers in comparison to unfolded, linearized peptides of the same primary sequence (except for the mutated cysteine residues).

Example 118

Fluorescence of Cartilage Homing Peptides

This example illustrates peptide homing to cartilage mice after administration of a peptide fluorophore conjugate. A peptide of SEQ ID NO: 592 was chemically conjugated to one molecule of Cyanine 5.5, and then imaged using the methods of EXAMPLE 46.

Figure 43A:
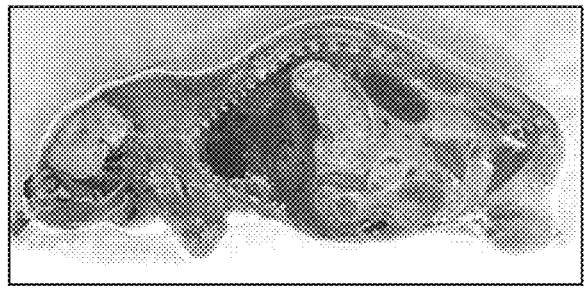
FIG. 43A-FIG. 43F shows white light images and corresponding whole body fluorescence images of a mouse administered 10 nmol of a peptide of SEQ ID NO: 592 conjugated to a Cy5.5 fluorophore (SEQ ID NO: 592A) at 24 hours post-administration.
Figure 43B:
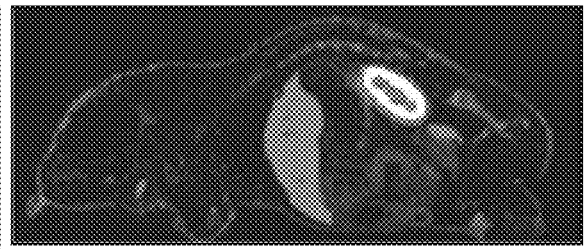
Figure 43C:
Figure 43D:
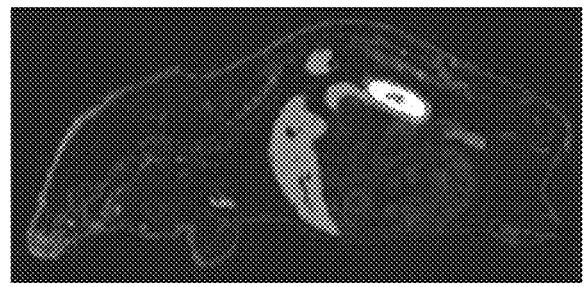
Figure 43E:
Figure 43F:
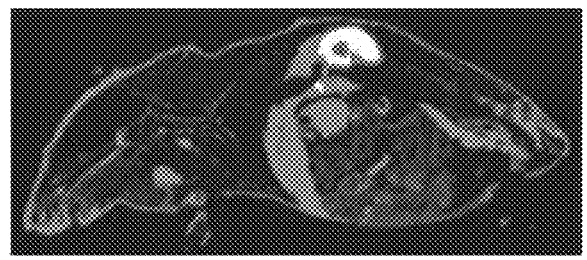

FIG. 43A-FIG. 43F shows white light images and corresponding whole body fluorescence images of a mouse administered 10 nmol of a peptide of SEQ ID NO: 592 conjugated to a Cy5.5 fluorophore (SEQ ID NO: 592A) at 24 hours post-administration. FIG. 43A illustrates an image of a frozen section of a mouse, 24 hours after administration of 10 nmol of a peptide of SEQ ID NO: 592 conjugated to a Cy5.5 fluorophore (SEQ ID NO: 592A). FIG. 43B illustrates the fluorescence signal in the mouse, corresponding to the section shown in FIG. 43A, 24 hours after administration of 10 nmol of a peptide of SEQ ID NO: 592 conjugated to a Cy5.5 fluorophore (SEQ ID NO: 592A). FIG. 43C illustrates an image of a different frozen section of the mouse, 24 hours after administration of 10 nmol of a peptide of SEQ ID NO: 592 conjugated to a Cy5.5 fluorophore (SEQ ID NO: 592A). FIG. 43D illustrates the fluorescence signal in the mouse, corresponding to the section shown in FIG. 43C, 24 hours after administration of 10 nmol of a peptide of SEQ ID NO: 592 conjugated to a Cy5.5 fluorophore (SEQ ID NO: 592A). FIG. 43E illustrates an image of a different frozen section of the mouse, 24 hours after administration of 10 nmol of a peptide of SEQ ID NO: 592 conjugated to a Cy5.5 fluorophore (SEQ ID NO: 592A). FIG. 43F illustrates a fluorescence signal in the mouse, corresponding to the section shown in FIG. 43E, 24 hours after administration of 10 nmol of a peptide of SEQ ID NO: 592 conjugated to a Cy5.5 fluorophore (SEQ ID NO: 592A).

FIG. 46A-FIG. 46H shows IVIS fluorescence imaging of an isolated hind limb from a first mouse and an isolated hind limb from a second mouse after administration of 10 nmol SEQ ID NO: 592 peptide conjugated to a Cy5.5 fluorophore (SEQ ID NO: 592A). FIG. 46A shows the right hind limb with skin removed from a first mouse and from a second mouse 3 hours after peptide administration. FIG. 46B shows the right hind limb with muscle removed from a first mouse and from a second mouse 3 hours after peptide administration. FIG. 46C shows the right hind limb with skin removed from a first mouse and from a second mouse 24 hours after peptide administration. FIG. 46D shows the right hind limb with muscle removed from a first mouse and from a second mouse 24 hours after peptide administration. FIG. 46E shows the right hind limb with skin removed from a first mouse and from a second mouse 48 hours after peptide administration. FIG. 46F shows the right hind limb with muscle removed from a first mouse and from a second mouse 48 hours after peptide administration. FIG. 46G shows the right hind limb with skin removed from a first mouse and from a second mouse 72 hours after peptide administration. FIG. 46H shows the right hind limb with muscle removed from a first mouse and from a second mouse 72 hours after peptide administration. Peptide fluorescence was observed in the knee joints of isolated right hind limbs at all time points tested.

Example 119

Peptide Resistance Under Various Conditions

This example illustrates peptide stability under various stress conditions such as high temperature, low pH, reducing agents, and proteases. To determine resistance to high temperatures, cystine-dense peptides (CDPs) were incubated at 0.5 mM in PBS at 75° C. or 100° C. for 1 h and pelleted, and the supernatant was analyzed with reversed-phase chromatography (RPC). To determine resistance to proteolytic digestion, CDPs were mixed with 50 U of porcine pepsin, in simulated gastric fluid at pH 1.0, or 50 U of porcine trypsin in PBS, incubated for 30 minutes at 37° C. and analyzed with RPC. Oxidized and reduced forms (prepared through addition 10 mM DTT) were compared. Circular Dichroism spectroscopy was used in order to measure the secondary structure of peptides with a Jasco J-720W spectropolarimeter in a cell with a 1.0-mm path length, and CDPs were diluted into 20 mM phosphate buffer, pH 7.4, at a concentration of 15-25 µM. These conditions were expected to denature or degrade conventional globular proteins and many peptides. In TABLE 61, "high" resistance indicated a high amount of the peptide remained or was retained as unmodified under the given experimental conditions and "low" resistance indicated a low amount of the peptide remained or was retained unmodified under the given experimental conditions. Notably, the experimental conditions described in this example were more extreme stress conditions than to many standard in vivo or physiologic conditions, in vitro conditions, conditions during manufacturing, and handling conditions. As such, even "low" resistance can indicate meaningful resistance to these stress conditions that may have applicability for a number of uses described herein. The data from these studies are shown in TABLE 61. The peptides tested, SEQ ID NO: 799, SEQ ID NO: 801 and SEQ ID NO: 966, showed high resistance to one or more of the conditions tested.

TABLE 61

Resistance of SEQ ID NO: 801, SEQ ID NO: 799, and SEQ ID NO: 966 to Various Conditions

| SEQ ID NO: | Resistance to Reduction | Resistance to 75° C. | Resistance to 100° C. | Resistance to Pepsin | Resistance to Trypsin |
|---|---|---|---|---|---|
| SEQ ID NO: 511 | High | High | High | High | High |
| SEQ ID NO: 509 | Low | High | Low | High | Low |
| SEQ ID NO: 676 | Low | High | Low | High | Low |

From the foregoing, it will be appreciated that, although specific embodiments of the invention have been described herein for purposes of illustration, various modifications may be made without deviating from the spirit and scope of the invention. Accordingly, the invention is not limited except as by the appended claims.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

REFERENCES

1. Deroose, J. P., Burger, J. W. A., van Geel, A. N., den Bakker, M. A., de Jong, J. S., Eggermont, A. M. M., and Verhoef, C. (2011) Radiotherapy for soft-tissue sarcomas after isolated limb perfusion and surgical resection: Essential for local control in all patients? Annals of Surgical Oncology 18, 321-327.
2. Paoloni, M. C., and Khanna, C. (2007) Comparative oncology today. Vet Clin North Am Small Anim Pract 37, 1023-v
3. Gordon, I., Paoloni, M., Mazcko, C., and Khanna, C. (2009) The Comparative Oncology Trials Consortium: Using spontaneously occurring cancers in dogs to inform the cancer drug development pathway. PLoS Med 6, e1000161
4. Goodman & Gilman's The Pharmacological Basis of Therapeutics., McGraw-Hill
5. Hargis, A., and Thomassen, R. (1979) Animal model: Solar dermatosis (keratosis) and solar dermatosis with squamous cell carcinoma. Am J Pathol 94, 193-196
6. Culard, J.-F., Basset-Seguin, N., Calas, B., Guilhou, J.-J., and Martin, F. (1992) Characterization and subcellular localization of calcium-dependent phospholipid binding proteins (annexins) in normal human skin and reconstituted epidermis. J Invest Dermatol 98, 436-441
7. Munz, B., Gerke, V., Gillitzer, R., and Werner, S. (1997) Differential expression of the calpactin I subunits annexin II and p$^1$ 1 in cultured keratinocytes and during wound repair. J Invest Dermatol 108, 307-312
8. Vail, D. M. (2004) Veterinary Co-operative oncology group. Vet Comp Oncol 2, 194-213
9. Dernell, W. S., Withrow, S. J., Kuntz, C. A., and Powers, B. E. (1998) Principles of treatment for soft-tissue sarcoma. Clinical Techniques in Small Animal Practice 13, 59-64
10. Motta, L., Mandara, M. T., and Skerritt, G. C. (2012) Canine and feline intracranial meningiomas: An updated review. The Veterinary Journal 192, 153-165
11. Lyons, S. A., O'Neal, J., and Sontheimer, H. (2002) Chlorotoxin, a scorpion-derived peptide, specifically binds to gliomas and tumors of neuroectodermal origin. Glia 39, 162-173
12. Stroud, M. R., Hansen, S. J., and Olson, J. M. (2011) In vivo bio-imaging using chlorotoxin-based conjugates. Curr. Pharm. Des. 17, 4362-4371
13. Veiseh, M., Gabikian, P., Bahrami, S.-B., Veiseh, O., Zhang, M., Hackman, R. C., Ravanpay, A. C., Stroud, M. R., Kusuma, Y., Hansen, S. J., Kwok, D., Munoz, N. M., Sze, R. W., Grady, W. M., Greenberg, N. M., Ellenbogen, R. G., and Olson, J. M. (2007) Tumor Paint: A chlorotoxin:Cy5.5 bioconjugate for intraoperative visualization of cancer foci. Cancer Res. 67, 6882-6888
14. Veiseh, O., Sun, C., Fang, C., Bhattarai, N., Gunn, J., Kievit, F., Du, K., Pullar, B., Lee, D., Ellenbogen, R. G., Olson, J., and Zhang, M. (2009) Specific targeting of brain tumors with an optical/magnetic resonance imaging nanoprobe across the blood-brain barrier. Cancer Res. 69, 6200-6207
15. Hockaday, D. C., Shen, S., Fiveash, J., Raubitschek, A., Colcher, D., Liu, A., Alvarez, V., and Mamelak, A. N. (2005) Imaging glioma extent with 131I-TM-601. The Journal of Nuclear Medicine 46, 580-586
16. Mamelak, A. N., Rosenfeld, S., Bucholz, R., Raubitschek, A., Nabors, L. B., Fiveash, J. B., Shen, S., Khazaeli, M. B., Colcher, D., Liu, A., Osman, M., Guthrie, B., Schade-Bijur, S., Hablitz, D. M., Alvarez, V. L., and Gonda, M. A. (2006) Phase I single-dose study of intracavitary-administered iodine-131-TM-601 in adults with recurrent high-grade glioma. Journal of Clinical Oncology 24, 3644-3650

---

SEQUENCE LISTING (1054 sequences)

SEQ ID NO: 1 - protein, 36 aa, Artificial Sequence
  Description of Artificial Sequence: Synthetic polypeptide
MCMPCFTTDHQMARKCDDCCGGKGRGKCYGPQCLCR

SEQ ID NO: 2 - protein, 36 aa, Artificial Sequence
  Description of Artificial Sequence: Synthetic polypeptide
MCMPCFTTDHQMARACDDCCGGKGRGKCYGPQCLCR

SEQ ID NO: 3 - protein, 36 aa, Artificial Sequence
  Description of Artificial Sequence: Synthetic polypeptide
MCMPCFTTDHQMARRCDDCCGGKGRGKCYGPQCLCR

SEQ ID NO: 4 - protein, 36 aa, Artificial Sequence
  Description of Artificial Sequence: Synthetic polypeptide
MCMPCFTTDHQMARKCDDCCGGAGRGKCYGPQCLCR

SEQ ID NO: 5 - protein, 36 aa, Artificial Sequence
  Description of Artificial Sequence: Synthetic polypeptide
MCMPCFTTDHQMARACDDCCGGAGRGKCYGPQCLCR

SEQ ID NO: 6 - protein, 36 aa, Artificial Sequence
  Description of Artificial Sequence: Synthetic polypeptide
MCMPCFTTDHQMARRCDDCCGGAGRGKCYGPQCLCR

SEQ ID NO: 7 - protein, 36 aa, Artificial Sequence
  Description of Artificial Sequence: Synthetic polypeptide
MCMPCFTTDHQMARKCDDCCGGRGRGKCYGPQCLCR

SEQ ID NO: 8 - protein, 36 aa, Artificial Sequence
  Description of Artificial Sequence: Synthetic polypeptide
MCMPCFTTDHQMARACDDCCGGRGRGKCYGPQCLCR

SEQ ID NO: 9 - protein, 36 aa, Artificial Sequence
  Description of Artificial Sequence: Synthetic polypeptide
MCMPCFTTDHQMARRCDDCCGGRGRGKCYGPQCLCR

SEQ ID NO: 10 - protein, 36 aa, Artificial Sequence
  Description of Artificial Sequence: Synthetic polypeptide
MCMPCFTTDHQMARKCDDCCGGKGRGACYGPQCLCR

SEQ ID NO: 11 - protein, 36 aa, Artificial Sequence
  Description of Artificial Sequence: Synthetic polypeptide
MCMPCFTTDHQMARACDDCCGGKGRGACYGPQCLCR

SEQ ID NO: 12 - protein, 36 aa, Artificial Sequence
  Description of Artificial Sequence: Synthetic polypeptide
MCMPCFTTDHQMARRCDDCCGGKGRGACYGPQCLCR

SEQ ID NO: 13 - protein, 36 aa, Artificial Sequence
  Description of Artificial Sequence: Synthetic polypeptide
MCMPCFTTDHQMARKCDDCCGGAGRGACYGPQCLCR

SEQ ID NO: 14 - protein, 36 aa, Artificial Sequence
  Description of Artificial Sequence: Synthetic polypeptide
MCMPCFTTDHQMARACDDCCGGAGRGACYGPQCLCR

SEQ ID NO: 15 - protein, 36 aa, Artificial Sequence
  Description of Artificial Sequence: Synthetic polypeptide
MCMPCFTTDHQMARRCDDCCGGAGRGACYGPQCLCR

SEQ ID NO: 16 - protein, 36 aa, Artificial Sequence
  Description of Artificial Sequence: Synthetic polypeptide
MCMPCFTTDHQMARKCDDCCGGRGRGACYGPQCLCR

SEQ ID NO: 17 - protein, 36 aa, Artificial Sequence
  Description of Artificial Sequence: Synthetic polypeptide
MCMPCFTTDHQMARACDDCCGGRGRGACYGPQCLCR

SEQ ID NO: 18 - protein, 36 aa, Artificial Sequence
  Description of Artificial Sequence: Synthetic polypeptide
MCMPCFTTDHQMARRCDDCCGGRGRGACYGPQCLCR

SEQ ID NO: 19 - protein, 36 aa, Artificial Sequence
  Description of Artificial Sequence: Synthetic polypeptide
MCMPCFTTDHQMARKCDDCCGGKGRGRCYGPQCLCR

SEQ ID NO: 20 - protein, 36 aa, Artificial Sequence
  Description of Artificial Sequence: Synthetic polypeptide
MCMPCFTTDHQMARACDDCCGGKGRGRCYGPQCLCR

SEQ ID NO: 21 - protein, 36 aa, Artificial Sequence
  Description of Artificial Sequence: Synthetic polypeptide
MCMPCFTTDHQMARRCDDCCGGKGRGRCYGPQCLCR

SEQ ID NO: 22 - protein, 36 aa, Artificial Sequence
  Description of Artificial Sequence: Synthetic polypeptide
MCMPCFTTDHQMARKCDDCCGGAGRGRCYGPQCLCR

SEQ ID NO: 23 - protein, 36 aa, Artificial Sequence
  Description of Artificial Sequence: Synthetic polypeptide
MCMPCFTTDHQMARACDDCCGGAGRGRCYGPQCLCR

SEQ ID NO: 24 - protein, 36 aa, Artificial Sequence
  Description of Artificial Sequence: Synthetic polypeptide
MCMPCFTTDHQMARRCDDCCGGAGRGRCYGPQCLCR

SEQ ID NO: 25 - protein, 36 aa, Artificial Sequence
  Description of Artificial Sequence: Synthetic polypeptide
MCMPCFTTDHQMARKCDDCCGGRGRGRCYGPQCLCR

SEQ ID NO: 26 - protein, 36 aa, Artificial Sequence
  Description of Artificial Sequence: Synthetic polypeptide
MCMPCFTTDHQMARACDDCCGGRGRGRCYGPQCLCR

SEQ ID NO: 27 - protein, 36 aa, Artificial Sequence
  Description of Artificial Sequence: Synthetic polypeptide
MCMPCFTTDHQMARRCDDCCGGRGRGRCYGPQCLCR

SEQ ID NO: 28 - protein, 36 aa, Artificial Sequence; identical to SEQ ID NO: 27
  Description of Artificial Sequence: Synthetic polypeptide

SEQ ID NO: 29 - protein, 36 aa, Artificial Sequence
  Description of Artificial Sequence: Synthetic polypeptide
KCMPCFTTDHQMARRCDDCCGGRGRGRCYGPQCLCR

SEQ ID NO: 30 - protein, 36 aa, Artificial Sequence
  Description of Artificial Sequence: Synthetic polypeptide
ACAPCFTTDHQAARRCDDCCGGRGRGRCYGPQCLCR

SEQ ID NO: 31 - protein, 36 aa, Artificial Sequence
  Description of Artificial Sequence: Synthetic polypeptide
KCAPCFTTDHQAARRCDDCCGGRGRGRCYGPQCLCR

SEQ ID NO: 32 - protein, 36 aa, Artificial Sequence
  Description of Artificial Sequence: Synthetic polypeptide
  MOD_RES (15)..(15): Citrulline
  MOD_RES (23)..(23): Citrulline
MCMPCFTTDHQMARXCDDCCGGXGRGKCYGPQCLCR

SEQ ID NO: 33 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
MCMPCFTTDHQMARXCDDCCGGXGRGXCYGPQCLCR

SEQ ID NO: 34 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCMPCFTTDHQMARXCDDCCGGXGRGXCYGPQCLCR

SEQ ID NO: 35 - protein, 36 aa, Artificial Sequence
  Description of Artificial Sequence: Synthetic polypeptide
  MOD_RES (15)..(15): Citrulline
  MOD_RES (23)..(23): Citrulline
ACAPCFTTDHQAARXCDDCCGGXGRGKCYGPQCLCR

SEQ ID NO: 36 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
ACAPCFTTDHQAARXCDDCCGGXGRGXCYGPQCLCR

SEQ ID NO: 37 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCAPCFTTDHQAARXCDDCCGGXGRGXCYGPQCLCR

SEQ ID NO: 38 - protein, 43 aa, Artificial Sequence
  Description of Artificial Sequence: Synthetic polypeptide
MCMPCFTTDHQMARKCDDCCGGKGRGKCYGPQCLCRGAGAAGG

SEQ ID NO: 39 - protein, 43 aa, Artificial Sequence
  Description of Artificial Sequence: Synthetic polypeptide
MCMPCFTTDHQMARACDDCCGGKGRGKCYGPQCLCRGAGAAGG

SEQ ID NO: 40 - protein, 43 aa, Artificial Sequence
  Description of Artificial Sequence: Synthetic polypeptide
MCMPCFTTDHQMARRCDDCCGGKGRGKCYGPQCLCRGAGAAGG

SEQ ID NO: 41 - protein, 43 aa, Artificial Sequence
  Description of Artificial Sequence: Synthetic polypeptide
MCMPCFTTDHQMARKCDDCCGGAGRGKCYGPQCLCRGAGAAGG

SEQ ID NO: 42 - protein, 43 aa, Artificial Sequence
  Description of Artificial Sequence: Synthetic polypeptide
MCMPCFTTDHQMARACDDCCGGAGRGKCYGPQCLCRGAGAAGG

SEQ ID NO: 43 - protein, 43 aa, Artificial Sequence
  Description of Artificial Sequence: Synthetic polypeptide
MCMPCFTTDHQMARRCDDCCGGAGRGKCYGPQCLCRGAGAAGG

SEQ ID NO: 44 - protein, 43 aa, Artificial Sequence
  Description of Artificial Sequence: Synthetic polypeptide
MCMPCFTTDHQMARKCDDCCGGRGRGKCYGPQCLCRGAGAAGG

SEQ ID NO: 45 - protein, 43 aa, Artificial Sequence
  Description of Artificial Sequence: Synthetic polypeptide
MCMPCFTTDHQMARACDDCCGGRGRGKCYGPQCLCRGAGAAGG

SEQ ID NO: 46 - protein, 43 aa, Artificial Sequence
  Description of Artificial Sequence: Synthetic polypeptide
MCMPCFTTDHQMARRCDDCCGGRGRGKCYGPQCLCRGAGAAGG

SEQ ID NO: 47 - protein, 43 aa, Artificial Sequence
  Description of Artificial Sequence: Synthetic polypeptide
MCMPCFTTDHQMARKCDDCCGGKGRGACYGPQCLCRGAGAAGG

SEQ ID NO: 48 - protein, 43 aa, Artificial Sequence
  Description of Artificial Sequence: Synthetic polypeptide
MCMPCFTTDHQMARACDDCCGGKGRGACYGPQCLCRGAGAAGG

SEQ ID NO: 49 - protein, 43 aa, Artificial Sequence
  Description of Artificial Sequence: Synthetic polypeptide
MCMPCFTTDHQMARRCDDCCGGKGRGACYGPQCLCRGAGAAGG

SEQ ID NO: 50 - protein, 43 aa, Artificial Sequence
  Description of Artificial Sequence: Synthetic polypeptide
MCMPCFTTDHQMARKCDDCCGGAGRGACYGPQCLCRGAGAAGG

SEQ ID NO: 51 - protein, 43 aa, Artificial Sequence
  Description of Artificial Sequence: Synthetic polypeptide
MCMPCFTTDHQMARACDDCCGGAGRGACYGPQCLCRGAGAAGG

SEQ ID NO: 52 - protein, 43 aa, Artificial Sequence
  Description of Artificial Sequence: Synthetic polypeptide
MCMPCFTTDHQMARRCDDCCGGAGRGACYGPQCLCRGAGAAGG

SEQ ID NO: 53 - protein, 43 aa, Artificial Sequence
  Description of Artificial Sequence: Synthetic polypeptide
MCMPCFTTDHQMARKCDDCCGGRGRGACYGPQCLCRGAGAAGG

SEQ ID NO: 54 - protein, 43 aa, Artificial Sequence
  Description of Artificial Sequence: Synthetic polypeptide
MCMPCFTTDHQMARACDDCCGGRGRGACYGPQCLCRGAGAAGG

SEQ ID NO: 55 - protein, 43 aa, Artificial Sequence
  Description of Artificial Sequence: Synthetic polypeptide
MCMPCFTTDHQMARRCDDCCGGRGRGACYGPQCLCRGAGAAGG

SEQ ID NO: 56 - protein, 43 aa, Artificial Sequence
  Description of Artificial Sequence: Synthetic polypeptide
MCMPCFTTDHQMARKCDDCCGGKGRGRCYGPQCLCRGAGAAGG

SEQ ID NO: 57 - protein, 43 aa, Artificial Sequence
  Description of Artificial Sequence: Synthetic polypeptide
MCMPCFTTDHQMARACDDCCGGKGRGRCYGPQCLCRGAGAAGG

SEQ ID NO: 58 - protein, 43 aa, Artificial Sequence
  Description of Artificial Sequence: Synthetic polypeptide
MCMPCFTTDHQMARRCDDCCGGKGRGRCYGPQCLCRGAGAAGG

SEQ ID NO: 59 - protein, 43 aa, Artificial Sequence
  Description of Artificial Sequence: Synthetic polypeptide
MCMPCFTTDHQMARKCDDCCGGAGRGRCYGPQCLCRGAGAAGG

SEQ ID NO: 60 - protein, 43 aa, Artificial Sequence
  Description of Artificial Sequence: Synthetic polypeptide
MCMPCFTTDHQMARACDDCCGGAGRGRCYGPQCLCRGAGAAGG

SEQ ID NO: 61 - protein, 43 aa, Artificial Sequence
  Description of Artificial Sequence: Synthetic polypeptide
MCMPCFTTDHQMARRCDDCCGGAGRGRCYGPQCLCRGAGAAGG

SEQ ID NO: 62 - protein, 43 aa, Artificial Sequence
  Description of Artificial Sequence: Synthetic polypeptide
MCMPCFTTDHQMARKCDDCCGGRGRGRCYGPQCLCRGAGAAGG

SEQ ID NO: 63 - protein, 43 aa, Artificial Sequence
  Description of Artificial Sequence: Synthetic polypeptide
MCMPCFTTDHQMARACDDCCGGRGRGRCYGPQCLCRGAGAAGG

SEQ ID NO: 64 - protein, 43 aa, Artificial Sequence
  Description of Artificial Sequence: Synthetic polypeptide
MCMPCFTTDHQMARRCDDCCGGRGRGRCYGPQCLCRGAGAAGG

SEQ ID NO: 65 - protein, 43 aa, Artificial Sequence; identical to SEQ ID NO: 64
  Description of Artificial Sequence: Synthetic polypeptide

SEQ ID NO: 66 - protein, 43 aa, Artificial Sequence
  Description of Artificial Sequence: Synthetic polypeptide
KCMPCFTTDHQMARRCDDCCGGRGRGRCYGPQCLCRGAGAAGG

SEQ ID NO: 67 - protein, 43 aa, Artificial Sequence
  Description of Artificial Sequence: Synthetic polypeptide
ACAPCFTTDHQAARRCDDCCGGRGRGRCYGPQCLCRGAGAAGG

SEQ ID NO: 68 - protein, 43 aa, Artificial Sequence
  Description of Artificial Sequence: Synthetic polypeptide
KCAPCFTTDHQAARRCDDCCGGRGRGRCYGPQCLCRGAGAAGG

SEQ ID NO: 69 - protein, 43 aa, Artificial Sequence
  Description of Artificial Sequence: Synthetic polypeptide
  MOD_RES (15)..(15): Citrulline
  MOD_RES (23)..(23): Citrulline
MCMPCFTTDHQMARXCDDCCGGXGRGKCYGPQCLCRGAGAAGG

SEQ ID NO: 70 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
MCMPCFTTDHQMARXCDDCCGGXGRGXCYGPQCLCRGAGAAGG

SEQ ID NO: 71 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCMPCFTTDHQMARXCDDCCGGXGRGXCYGPQCLCRGAGAAGG

SEQ ID NO: 72 - protein, 43 aa, Artificial Sequence
  Description of Artificial Sequence: Synthetic polypeptide
  MOD_RES (15)..(15): Citrulline
  MOD_RES (23)..(23): Citrulline
ACAPCFTTDHQAARXCDDCCGGXGRGKCYGPQCLCRGAGAAGG

SEQ ID NO: 73 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
ACAPCFTTDHQAARXCDDCCGGXGRGXCYGPQCLCRGAGAAGG

SEQ ID NO: 74 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCAPCFTTDHQAARXCDDCCGGXGRGXCYGPQCLCRGAGAAGG

SEQ ID NO: 75 - protein, 36 aa, Artificial Sequence
  Description of Artificial Sequence: Synthetic polypeptide
MCMPCFTTDHQMVRKCDDCCGGKGRGKCYGPQCLCR

SEQ ID NO: 76 - protein, 36 aa, Artificial Sequence
  Description of Artificial Sequence: Synthetic polypeptide
MCMPCFTTDHQMVRVCDDCCGGKGRGKCYGPQCLCR

SEQ ID NO: 77 - protein, 36 aa, Artificial Sequence
  Description of Artificial Sequence: Synthetic polypeptide
MCMPCFTTDHQMVRRCDDCCGGKGRGKCYGPQCLCR

SEQ ID NO: 78 - protein, 36 aa, Artificial Sequence
  Description of Artificial Sequence: Synthetic polypeptide
MCMPCFTTDHQMVRKCDDCCGGVGRGKCYGPQCLCR

SEQ ID NO: 79 - protein, 36 aa, Artificial Sequence
  Description of Artificial Sequence: Synthetic polypeptide
MCMPCFTTDHQMVRVCDDCCGGVGRGKCYGPQCLCR

SEQ ID NO: 80 - protein, 36 aa, Artificial Sequence
  Description of Artificial Sequence: Synthetic polypeptide
MCMPCFTTDHQMVRRCDDCCGGVGRGKCYGPQCLCR

SEQ ID NO: 81 - protein, 36 aa, Artificial Sequence
  Description of Artificial Sequence: Synthetic polypeptide
MCMPCFTTDHQMVRKCDDCCGGRGRGKCYGPQCLCR

SEQ ID NO: 82 - protein, 36 aa, Artificial Sequence
  Description of Artificial Sequence: Synthetic polypeptide
MCMPCFTTDHQMVRVCDDCCGGRGRGKCYGPQCLCR

SEQ ID NO: 83 - protein, 36 aa, Artificial Sequence
  Description of Artificial Sequence: Synthetic polypeptide
MCMPCFTTDHQMVRRCDDCCGGRGRGKCYGPQCLCR

SEQ ID NO: 84 - protein, 36 aa, Artificial Sequence
  Description of Artificial Sequence: Synthetic polypeptide
MCMPCFTTDHQMVRKCDDCCGGKGRGVCYGPQCLCR

SEQ ID NO: 85 - protein, 36 aa, Artificial Sequence
  Description of Artificial Sequence: Synthetic polypeptide
MCMPCFTTDHQMVRVCDDCCGGKGRGVCYGPQCLCR

SEQ ID NO: 86 - protein, 36 aa, Artificial Sequence
  Description of Artificial Sequence: Synthetic polypeptide
MCMPCFTTDHQMVRRCDDCCGGKGRGVCYGPQCLCR

SEQ ID NO: 87 - protein, 36 aa, Artificial Sequence
  Description of Artificial Sequence: Synthetic polypeptide
MCMPCFTTDHQMVRKCDDCCGGVGRGVCYGPQCLCR

SEQ ID NO: 88 - protein, 36 aa, Artificial Sequence
  Description of Artificial Sequence: Synthetic polypeptide
MCMPCFTTDHQMVRVCDDCCGGVGRGVCYGPQCLCR

SEQ ID NO: 89 - protein, 36 aa, Artificial Sequence
  Description of Artificial Sequence: Synthetic polypeptide
MCMPCFTTDHQMVRRCDDCCGGVGRGVCYGPQCLCR

SEQ ID NO: 90 - protein, 36 aa, Artificial Sequence
  Description of Artificial Sequence: Synthetic polypeptide
MCMPCFTTDHQMVRKCDDCCGGRGRGVCYGPQCLCR

SEQ ID NO: 91 - protein, 36 aa, Artificial Sequence
  Description of Artificial Sequence: Synthetic polypeptide
MCMPCFTTDHQMVRVCDDCCGGRGRGVCYGPQCLCR

SEQ ID NO: 92 - protein, 36 aa, Artificial Sequence
  Description of Artificial Sequence: Synthetic polypeptide
MCMPCFTTDHQMVRRCDDCCGGRGRGVCYGPQCLCR

SEQ ID NO: 93 - protein, 36 aa, Artificial Sequence
  Description of Artificial Sequence: Synthetic polypeptide
MCMPCFTTDHQMVRKCDDCCGGKGRGRCYGPQCLCR

SEQ ID NO: 94 - protein, 36 aa, Artificial Sequence
  Description of Artificial Sequence: Synthetic polypeptide
MCMPCFTTDHQMVRVCDDCCGGKGRGRCYGPQCLCR

SEQ ID NO: 95 - protein, 36 aa, Artificial Sequence
  Description of Artificial Sequence: Synthetic polypeptide
MCMPCFTTDHQMVRRCDDCCGGKGRGRCYGPQCLCR

SEQ ID NO: 96 - protein, 36 aa, Artificial Sequence
  Description of Artificial Sequence: Synthetic polypeptide
MCMPCFTTDHQMVRKCDDCCGGVGRGRCYGPQCLCR

SEQ ID NO: 97 - protein, 36 aa, Artificial Sequence
  Description of Artificial Sequence: Synthetic polypeptide
MCMPCFTTDHQMVRVCDDCCGGVGRGRCYGPQCLCR

SEQ ID NO: 98 - protein, 36 aa, Artificial Sequence
  Description of Artificial Sequence: Synthetic polypeptide
MCMPCFTTDHQMVRRCDDCCGGVGRGRCYGPQCLCR

SEQ ID NO: 99 - protein, 36 aa, Artificial Sequence
  Description of Artificial Sequence: Synthetic polypeptide
MCMPCFTTDHQMVRKCDDCCGGRGRGRCYGPQCLCR

SEQ ID NO: 100 - protein, 36 aa, Artificial Sequence
  Description of Artificial Sequence: Synthetic polypeptide
MCMPCFTTDHQMVRVCDDCCGGRGRGRCYGPQCLCR

SEQ ID NO: 101 - protein, 36 aa, Artificial Sequence
  Description of Artificial Sequence: Synthetic polypeptide
MCMPCFTTDHQMVRRCDDCCGGRGRGRCYGPQCLCR

SEQ ID NO: 102 - protein, 36 aa, Artificial Sequence; identical to SEQ ID NO: 101
  Description of Artificial Sequence: Synthetic polypeptide

SEQ ID NO: 103 - protein, 36 aa, Artificial Sequence
  Description of Artificial Sequence: Synthetic polypeptide
KCMPCFTTDHQMVRRCDDCCGGRGRGRCYGPQCLCR

SEQ ID NO: 104 - protein, 36 aa, Artificial Sequence
  Description of Artificial Sequence: Synthetic polypeptide
VCVPCFTTDHQVVRRCDDCCGGRGRGRCYGPQCLCR

SEQ ID NO: 105 - protein, 36 aa, Artificial Sequence
  Description of Artificial Sequence: Synthetic polypeptide
KCVPCFTTDHQVVRRCDDCCGGRGRGRCYGPQCLCR

SEQ ID NO: 106 - protein, 36 aa, Artificial Sequence
  Description of Artificial Sequence: Synthetic polypeptide
  MOD_RES (15)..(15): Citrulline
  MOD_RES (23)..(23): Citrulline
MCMPCFTTDHQMVRXCDDCCGGXGRGKCYGPQCLCR

SEQ ID NO: 107 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
MCMPCFTTDHQMVRXCDDCCGGXGRGXCYGPQCLCR

SEQ ID NO: 108 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCMPCFTTDHQMVRXCDDCCGGXGRGXCYGPQCLCR

SEQ ID NO: 109 - protein, 36 aa, Artificial Sequence
  Description of Artificial Sequence: Synthetic polypeptide
  MOD_RES (15)..(15): Citrulline
  MOD_RES (23)..(23): Citrulline
VCVPCFTTDHQVVRXCDDCCGGXGRGKCYGPQCLCR

SEQ ID NO: 110 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
VCVPCFTTDHQVVRXCDDCCGGXGRGXCYGPQCLCR

SEQ ID NO: 111 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCVPCFTTDHQVVRXCDDCCGGXGRGXCYGPQCLCR

SEQ ID NO: 112 - protein, 43 aa, Artificial Sequence
  Description of Artificial Sequence: Synthetic polypeptide
MCMPCFTTDHQMVRKCDDCCGGKGRGKCYGPQCLCRGAGAAGG

SEQ ID NO: 113 - protein, 43 aa, Artificial Sequence
  Description of Artificial Sequence: Synthetic polypeptide
MCMPCFTTDHQMVRVCDDCCGGKGRGKCYGPQCLCRGAGAAGG

SEQ ID NO: 114 - protein, 43 aa, Artificial Sequence
  Description of Artificial Sequence: Synthetic polypeptide
MCMPCFTTDHQMVRRCDDCCGGKGRGKCYGPQCLCRGAGAAGG

SEQ ID NO: 115 - protein, 43 aa, Artificial Sequence
  Description of Artificial Sequence: Synthetic polypeptide
MCMPCFTTDHQMVRKCDDCCGGVGRGKCYGPQCLCRGAGAAGG

SEQ ID NO: 116 - protein, 43 aa, Artificial Sequence
  Description of Artificial Sequence: Synthetic polypeptide
MCMPCFTTDHQMVRVCDDCCGGVGRGKCYGPQCLCRGAGAAGG

SEQ ID NO: 117 - protein, 43 aa, Artificial Sequence
  Description of Artificial Sequence: Synthetic polypeptide
MCMPCFTTDHQMVRRCDDCCGGVGRGKCYGPQCLCRGAGAAGG

SEQ ID NO: 118 - protein, 43 aa, Artificial Sequence
  Description of Artificial Sequence: Synthetic polypeptide
MCMPCFTTDHQMVRKCDDCCGGRGRGKCYGPQCLCRGAGAAGG

SEQ ID NO: 119 - protein, 43 aa, Artificial Sequence
  Description of Artificial Sequence: Synthetic polypeptide
MCMPCFTTDHQMVRVCDDCCGGRGRGKCYGPQCLCRGAGAAGG

SEQ ID NO: 120 - protein, 43 aa, Artificial Sequence
  Description of Artificial Sequence: Synthetic polypeptide
MCMPCFTTDHQMVRRCDDCCGGRGRGKCYGPQCLCRGAGAAGG

SEQ ID NO: 121 - protein, 43 aa, Artificial Sequence
  Description of Artificial Sequence: Synthetic polypeptide
MCMPCFTTDHQMVRKCDDCCGGKGRGVCYGPQCLCRGAGAAGG

SEQ ID NO: 122 - protein, 43 aa, Artificial Sequence
  Description of Artificial Sequence: Synthetic polypeptide
MCMPCFTTDHQMVRVCDDCCGGKGRGVCYGPQCLCRGAGAAGG

SEQ ID NO: 123 - protein, 43 aa, Artificial Sequence
  Description of Artificial Sequence: Synthetic polypeptide
MCMPCFTTDHQMVRRCDDCCGGKGRGVCYGPQCLCRGAGAAGG

SEQ ID NO: 124 - protein, 43 aa, Artificial Sequence
  Description of Artificial Sequence: Synthetic polypeptide
MCMPCFTTDHQMVRKCDDCCGGVGRGVCYGPQCLCRGAGAAGG

SEQ ID NO: 125 - protein, 43 aa, Artificial Sequence
  Description of Artificial Sequence: Synthetic polypeptide
MCMPCFTTDHQMVRVCDDCCGGVGRGVCYGPQCLCRGAGAAGG

SEQ ID NO: 126 - protein, 43 aa, Artificial Sequence
  Description of Artificial Sequence: Synthetic polypeptide
MCMPCFTTDHQMVRRCDDCCGGVGRGVCYGPQCLCRGAGAAGG

SEQ ID NO: 127 - protein, 43 aa, Artificial Sequence
  Description of Artificial Sequence: Synthetic polypeptide
MCMPCFTTDHQMVRKCDDCCGGRGRGVCYGPQCLCRGAGAAGG

SEQ ID NO: 128 - protein, 43 aa, Artificial Sequence
  Description of Artificial Sequence: Synthetic polypeptide
MCMPCFTTDHQMVRVCDDCCGGRGRGVCYGPQCLCRGAGAAGG

SEQ ID NO: 129 - protein, 43 aa, Artificial Sequence
  Description of Artificial Sequence: Synthetic polypeptide
MCMPCFTTDHQMVRRCDDCCGGRGRGVCYGPQCLCRGAGAAGG

SEQ ID NO: 130 - protein, 43 aa, Artificial Sequence
  Description of Artificial Sequence: Synthetic polypeptide
MCMPCFTTDHQMVRKCDDCCGGKGRGRCYGPQCLCRGAGAAGG

SEQ ID NO: 131 - protein, 43 aa, Artificial Sequence
  Description of Artificial Sequence: Synthetic polypeptide
MCMPCFTTDHQMVRVCDDCCGGKGRGRCYGPQCLCRGAGAAGG

SEQ ID NO: 132 - protein, 43 aa, Artificial Sequence
  Description of Artificial Sequence: Synthetic polypeptide
MCMPCFTTDHQMVRRCDDCCGGKGRGRCYGPQCLCRGAGAAGG

SEQ ID NO: 133 - protein, 43 aa, Artificial Sequence
  Description of Artificial Sequence: Synthetic polypeptide
MCMPCFTTDHQMVRKCDDCCGGVGRGRCYGPQCLCRGAGAAGG

SEQ ID NO: 134 - protein, 43 aa, Artificial Sequence
  Description of Artificial Sequence: Synthetic polypeptide
MCMPCFTTDHQMVRVCDDCCGGVGRGRCYGPQCLCRGAGAAGG

SEQ ID NO: 135 - protein, 43 aa, Artificial Sequence
  Description of Artificial Sequence: Synthetic polypeptide
MCMPCFTTDHQMVRRCDDCCGGVGRGRCYGPQCLCRGAGAAGG

SEQ ID NO: 136 - protein, 43 aa, Artificial Sequence
  Description of Artificial Sequence: Synthetic polypeptide
MCMPCFTTDHQMVRKCDDCCGGRGRGRCYGPQCLCRGAGAAGG

SEQ ID NO: 137 - protein, 43 aa, Artificial Sequence
  Description of Artificial Sequence: Synthetic polypeptide
MCMPCFTTDHQMVRVCDDCCGGRGRGRCYGPQCLCRGAGAAGG

SEQ ID NO: 138 - protein, 43 aa, Artificial Sequence
  Description of Artificial Sequence: Synthetic polypeptide
MCMPCFTTDHQMVRRCDDCCGGRGRGRCYGPQCLCRGAGAAGG

SEQ ID NO: 139 - protein, 43 aa, Artificial Sequence; identical to SEQ ID NO: 138
  Description of Artificial Sequence: Synthetic polypeptide

SEQ ID NO: 140 - protein, 43 aa, Artificial Sequence
  Description of Artificial Sequence: Synthetic polypeptide
KCMPCFTTDHQMVRRCDDCCGGRGRGRCYGPQCLCRGAGAAGG

SEQ ID NO: 141 - protein, 43 aa, Artificial Sequence
  Description of Artificial Sequence: Synthetic polypeptide
VCVPCFTTDHQVVRRCDDCCGGRGRGRCYGPQCLCRGAGAAGG

SEQ ID NO: 142 - protein, 43 aa, Artificial Sequence
  Description of Artificial Sequence: Synthetic polypeptide
KCVPCFTTDHQVVRRCDDCCGGRGRGRCYGPQCLCRGAGAAGG

SEQ ID NO: 143 - protein, 43 aa, Artificial Sequence
  Description of Artificial Sequence: Synthetic polypeptide
  MOD_RES (15)..(15): Citrulline
  MOD_RES (23)..(23): Citrulline
MCMPCFTTDHQMVRXCDDCCGGXGRGKCYGPQCLCRGAGAAGG

SEQ ID NO: 144 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
MCMPCFTTDHQMVRXCDDCCGGXGRGXCYGPQCLCRGAGAAGG

SEQ ID NO: 145 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCMPCFTTDHQMVRXCDDCCGGXGRGXCYGPQCLCRGAGAAGG

SEQ ID NO: 146 - protein, 43 aa, Artificial Sequence
  Description of Artificial Sequence: Synthetic polypeptide
  MOD_RES (15)..(15): Citrulline
  MOD_RES (23)..(23): Citrulline
VCVPCFTTDHQVVRXCDDCCGGXGRGKCYGPQCLCRGAGAAGG

SEQ ID NO: 147 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
VCVPCFTTDHQVVRXCDDCCGGXGRGXCYGPQCLCRGAGAAGG

SEQ ID NO: 148 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCVPCFTTDHQVVRXCDDCCGGXGRGXCYGPQCLCRGAGAAGG

SEQ ID NO: 149 - protein, 36 aa, Artificial Sequence
  Description of Artificial Sequence: Synthetic polypeptide
MCMPCFTTDHQMLRKCDDCCGGKGRGKCYGPQCLCR

SEQ ID NO: 150 - protein, 36 aa, Artificial Sequence
  Description of Artificial Sequence: Synthetic polypeptide
MCMPCFTTDHQMLRLCDDCCGGKGRGKCYGPQCLCR

SEQ ID NO: 151 - protein, 36 aa, Artificial Sequence
  Description of Artificial Sequence: Synthetic polypeptide
MCMPCFTTDHQMLRRCDDCCGGKGRGKCYGPQCLCR

SEQ ID NO: 152 - protein, 36 aa, Artificial Sequence
  Description of Artificial Sequence: Synthetic polypeptide
MCMPCFTTDHQMLRKCDDCCGGLGRGKCYGPQCLCR

SEQ ID NO: 153 - protein, 36 aa, Artificial Sequence
  Description of Artificial Sequence: Synthetic polypeptide
MCMPCFTTDHQMLRLCDDCCGGLGRGKCYGPQCLCR

SEQ ID NO: 154 - protein, 36 aa, Artificial Sequence
  Description of Artificial Sequence: Synthetic polypeptide
MCMPCFTTDHQMLRRCDDCCGGLGRGKCYGPQCLCR

SEQ ID NO: 155 - protein, 36 aa, Artificial Sequence
  Description of Artificial Sequence: Synthetic polypeptide
MCMPCFTTDHQMLRKCDDCCGGRGRGKCYGPQCLCR

SEQ ID NO: 156 - protein, 36 aa, Artificial Sequence
  Description of Artificial Sequence: Synthetic polypeptide
MCMPCFTTDHQMLRLCDDCCGGRGRGKCYGPQCLCR

SEQ ID NO: 157 - protein, 36 aa, Artificial Sequence
  Description of Artificial Sequence: Synthetic polypeptide
MCMPCFTTDHQMLRRCDDCCGGRGRGKCYGPQCLCR

SEQ ID NO: 158 - protein, 36 aa, Artificial Sequence
  Description of Artificial Sequence: Synthetic polypeptide
MCMPCFTTDHQMLRKCDDCCGGKGRGLCYGPQCLCR

SEQ ID NO: 159 - protein, 36 aa, Artificial Sequence
  Description of Artificial Sequence: Synthetic polypeptide
MCMPCFTTDHQMLRLCDDCCGGKGRGLCYGPQCLCR

SEQ ID NO: 160 - protein, 36 aa, Artificial Sequence
  Description of Artificial Sequence: Synthetic polypeptide
MCMPCFTTDHQMLRRCDDCCGGKGRGLCYGPQCLCR

SEQ ID NO: 161 - protein, 36 aa, Artificial Sequence
  Description of Artificial Sequence: Synthetic polypeptide
MCMPCFTTDHQMLRKCDDCCGGLGRGLCYGPQCLCR

SEQ ID NO: 162 - protein, 36 aa, Artificial Sequence
  Description of Artificial Sequence: Synthetic polypeptide
MCMPCFTTDHQMLRLCDDCCGGLGRGLCYGPQCLCR

SEQ ID NO: 163 - protein, 36 aa, Artificial Sequence
  Description of Artificial Sequence: Synthetic polypeptide
MCMPCFTTDHQMLRRCDDCCGGLGRGLCYGPQCLCR

SEQ ID NO: 164 - protein, 36 aa, Artificial Sequence
  Description of Artificial Sequence: Synthetic polypeptide
MCMPCFTTDHQMLRKCDDCCGGRGRGLCYGPQCLCR

SEQ ID NO: 165 - protein, 36 aa, Artificial Sequence
  Description of Artificial Sequence: Synthetic polypeptide
MCMPCFTTDHQMLRLCDDCCGGRGRGLCYGPQCLCR

SEQ ID NO: 166 - protein, 36 aa, Artificial Sequence
  Description of Artificial Sequence: Synthetic polypeptide
MCMPCFTTDHQMLRRCDDCCGGRGRGLCYGPQCLCR

SEQ ID NO: 167 - protein, 36 aa, Artificial Sequence
  Description of Artificial Sequence: Synthetic polypeptide
MCMPCFTTDHQMLRKCDDCCGGKGRGRCYGPQCLCR

SEQ ID NO: 168 - protein, 36 aa, Artificial Sequence
  Description of Artificial Sequence: Synthetic polypeptide
MCMPCFTTDHQMLRLCDDCCGGKGRGRCYGPQCLCR

SEQ ID NO: 169 - protein, 36 aa, Artificial Sequence
  Description of Artificial Sequence: Synthetic polypeptide
MCMPCFTTDHQMLRRCDDCCGGKGRGRCYGPQCLCR

SEQ ID NO: 170 - protein, 36 aa, Artificial Sequence
  Description of Artificial Sequence: Synthetic polypeptide
MCMPCFTTDHQMLRKCDDCCGGLGRGRCYGPQCLCR

SEQ ID NO: 171 - protein, 36 aa, Artificial Sequence
  Description of Artificial Sequence: Synthetic polypeptide
MCMPCFTTDHQMLRLCDDCCGGLGRGRCYGPQCLCR

SEQ ID NO: 172 - protein, 36 aa, Artificial Sequence
  Description of Artificial Sequence: Synthetic polypeptide
MCMPCFTTDHQMLRRCDDCCGGLGRGRCYGPQCLCR

SEQ ID NO: 173 - protein, 36 aa, Artificial Sequence
  Description of Artificial Sequence: Synthetic polypeptide
MCMPCFTTDHQMLRKCDDCCGGRGRGRCYGPQCLCR

SEQ ID NO: 174 - protein, 36 aa, Artificial Sequence
  Description of Artificial Sequence: Synthetic polypeptide
MCMPCFTTDHQMLRLCDDCCGGRGRGRCYGPQCLCR

SEQ ID NO: 175 - protein, 36 aa, Artificial Sequence
  Description of Artificial Sequence: Synthetic polypeptide
MCMPCFTTDHQMLRRCDDCCGGRGRGRCYGPQCLCR

SEQ ID NO: 176 - protein, 36 aa, Artificial Sequence; identical to SEQ ID NO: 175
  Description of Artificial Sequence: Synthetic polypeptide

SEQ ID NO: 177 - protein, 36 aa, Artificial Sequence
  Description of Artificial Sequence: Synthetic polypeptide
KCMPCFTTDHQMLRRCDDCCGGRGRGRCYGPQCLCR

SEQ ID NO: 178 - protein, 36 aa, Artificial Sequence
  Description of Artificial Sequence: Synthetic polypeptide
LCLPCFTTDHQLLRRCDDCCGGRGRGRCYGPQCLCR

SEQ ID NO: 179 - protein, 36 aa, Artificial Sequence
  Description of Artificial Sequence: Synthetic polypeptide
KCLPCFTTDHQLLRRCDDCCGGRGRGRCYGPQCLCR

SEQ ID NO: 180 - protein, 36 aa, Artificial Sequence
  Description of Artificial Sequence: Synthetic polypeptide
  MOD_RES (15)..(15): Citrulline
  MOD_RES (23)..(23): Citrulline
MCMPCFTTDHQMLRXCDDCCGGXGRGKCYGPQCLCR

SEQ ID NO: 181 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
MCMPCFTTDHQMLRXCDDCCGGXGRGXCYGPQCLCR

SEQ ID NO: 182 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCMPCFTTDHQMLRXCDDCCGGXGRGXCYGPQCLCR

SEQ ID NO: 183 - protein, 36 aa, Artificial Sequence
  Description of Artificial Sequence: Synthetic polypeptide
  MOD_RES (15)..(15): Citrulline
  MOD_RES (23)..(23): Citrulline
LCLPCFTTDHQLLRXCDDCCGGXGRGKCYGPQCLCR

SEQ ID NO: 184 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
LCLPCFTTDHQLLRXCDDCCGGXGRGXCYGPQCLCR

SEQ ID NO: 185 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCLPCFTTDHQLLRXCDDCCGGXGRGXCYGPQCLCR

SEQ ID NO: 186 - protein, 43 aa, Artificial Sequence
  Description of Artificial Sequence: Synthetic polypeptide
MCMPCFTTDHQMLRKCDDCCGGKGRGKCYGPQCLCRGAGAAGG

SEQ ID NO: 187 - protein, 43 aa, Artificial Sequence
  Description of Artificial Sequence: Synthetic polypeptide
MCMPCFTTDHQMLRLCDDCCGGKGRGKCYGPQCLCRGAGAAGG

SEQ ID NO: 188 - protein, 43 aa, Artificial Sequence
  Description of Artificial Sequence: Synthetic polypeptide
MCMPCFTTDHQMLRRCDDCCGGKGRGKCYGPQCLCRGAGAAGG

SEQ ID NO: 189 - protein, 43 aa, Artificial Sequence
  Description of Artificial Sequence: Synthetic polypeptide
MCMPCFTTDHQMLRKCDDCCGGLGRGKCYGPQCLCRGAGAAGG

SEQ ID NO: 190 - protein, 43 aa, Artificial Sequence
  Description of Artificial Sequence: Synthetic polypeptide
MCMPCFTTDHQMLRLCDDCCGGLGRGKCYGPQCLCRGAGAAGG

SEQ ID NO: 191 - protein, 43 aa, Artificial Sequence
  Description of Artificial Sequence: Synthetic polypeptide
MCMPCFTTDHQMLRRCDDCCGGLGRGKCYGPQCLCRGAGAAGG

SEQ ID NO: 192 - protein, 43 aa, Artificial Sequence
  Description of Artificial Sequence: Synthetic polypeptide
MCMPCFTTDHQMLRKCDDCCGGRGRGKCYGPQCLCRGAGAAGG

SEQ ID NO: 193 - protein, 43 aa, Artificial Sequence
  Description of Artificial Sequence: Synthetic polypeptide
MCMPCFTTDHQMLRLCDDCCGGRGRGKCYGPQCLCRGAGAAGG

SEQ ID NO: 194 - protein, 43 aa, Artificial Sequence
  Description of Artificial Sequence: Synthetic polypeptide
MCMPCFTTDHQMLRRCDDCCGGRGRGKCYGPQCLCRGAGAAGG

SEQ ID NO: 195 - protein, 43 aa, Artificial Sequence
  Description of Artificial Sequence: Synthetic polypeptide
MCMPCFTTDHQMLRKCDDCCGGKGRGLCYGPQCLCRGAGAAGG

SEQ ID NO: 196 - protein, 43 aa, Artificial Sequence
  Description of Artificial Sequence: Synthetic polypeptide
MCMPCFTTDHQMLRLCDDCCGGKGRGLCYGPQCLCRGAGAAGG

SEQ ID NO: 197 - protein, 43 aa, Artificial Sequence
  Description of Artificial Sequence: Synthetic polypeptide
MCMPCFTTDHQMLRRCDDCCGGKGRGLCYGPQCLCRGAGAAGG

SEQ ID NO: 198 - protein, 43 aa, Artificial Sequence
  Description of Artificial Sequence: Synthetic polypeptide
MCMPCFTTDHQMLRKCDDCCGGLGRGLCYGPQCLCRGAGAAGG

SEQ ID NO: 199 - protein, 43 aa, Artificial Sequence
  Description of Artificial Sequence: Synthetic polypeptide
MCMPCFTTDHQMLRLCDDCCGGLGRGLCYGPQCLCRGAGAAGG

SEQ ID NO: 200 - protein, 43 aa, Artificial Sequence
  Description of Artificial Sequence: Synthetic polypeptide
MCMPCFTTDHQMLRRCDDCCGGLGRGLCYGPQCLCRGAGAAGG

SEQ ID NO: 201 - protein, 43 aa, Artificial Sequence
  Description of Artificial Sequence: Synthetic polypeptide
MCMPCFTTDHQMLRKCDDCCGGRGRGLCYGPQCLCRGAGAAGG

SEQ ID NO: 202 - protein, 43 aa, Artificial Sequence
  Description of Artificial Sequence: Synthetic polypeptide
MCMPCFTTDHQMLRLCDDCCGGRGRGLCYGPQCLCRGAGAAGG

SEQ ID NO: 203 - protein, 43 aa, Artificial Sequence
  Description of Artificial Sequence: Synthetic polypeptide
MCMPCFTTDHQMLRRCDDCCGGRGRGLCYGPQCLCRGAGAAGG

SEQ ID NO: 204 - protein, 43 aa, Artificial Sequence
  Description of Artificial Sequence: Synthetic polypeptide
MCMPCFTTDHQMLRKCDDCCGGKGRGRCYGPQCLCRGAGAAGG

SEQ ID NO: 205 - protein, 43 aa, Artificial Sequence
  Description of Artificial Sequence: Synthetic polypeptide
MCMPCFTTDHQMLRLCDDCCGGKGRGRCYGPQCLCRGAGAAGG

SEQ ID NO: 206 - protein, 43 aa, Artificial Sequence
  Description of Artificial Sequence: Synthetic polypeptide
MCMPCFTTDHQMLRRCDDCCGGKGRGRCYGPQCLCRGAGAAGG

SEQ ID NO: 207 - protein, 43 aa, Artificial Sequence
  Description of Artificial Sequence: Synthetic polypeptide
MCMPCFTTDHQMLRKCDDCCGGLGRGRCYGPQCLCRGAGAAGG

SEQ ID NO: 208 - protein, 43 aa, Artificial Sequence
  Description of Artificial Sequence: Synthetic polypeptide
MCMPCFTTDHQMLRLCDDCCGGLGRGRCYGPQCLCRGAGAAGG

SEQ ID NO: 209 - protein, 43 aa, Artificial Sequence
  Description of Artificial Sequence: Synthetic polypeptide
MCMPCFTTDHQMLRRCDDCCGGLGRGRCYGPQCLCRGAGAAGG

SEQ ID NO: 210 - protein, 43 aa, Artificial Sequence
  Description of Artificial Sequence: Synthetic polypeptide
MCMPCFTTDHQMLRKCDDCCGGRGRGRCYGPQCLCRGAGAAGG

SEQ ID NO: 211 - protein, 43 aa, Artificial Sequence
  Description of Artificial Sequence: Synthetic polypeptide
MCMPCFTTDHQMLRLCDDCCGGRGRGRCYGPQCLCRGAGAAGG

SEQ ID NO: 212 - protein, 43 aa, Artificial Sequence
  Description of Artificial Sequence: Synthetic polypeptide
MCMPCFTTDHQMLRRCDDCCGGRGRGRCYGPQCLCRGAGAAGG

SEQ ID NO: 213 - protein, 43 aa, Artificial Sequence; identical to SEQ ID NO: 212
  Description of Artificial Sequence: Synthetic polypeptide

SEQ ID NO: 214 - protein, 43 aa, Artificial Sequence
  Description of Artificial Sequence: Synthetic polypeptide
KCMPCFTTDHQMLRRCDDCCGGRGRGRCYGPQCLCRGAGAAGG

SEQ ID NO: 215 - protein, 43 aa, Artificial Sequence
  Description of Artificial Sequence: Synthetic polypeptide
LCLPCFTTDHQLLRRCDDCCGGRGRGRCYGPQCLCRGAGAAGG

SEQ ID NO: 216 - protein, 43 aa, Artificial Sequence
  Description of Artificial Sequence: Synthetic polypeptide
KCLPCFTTDHQLLRRCDDCCGGRGRGRCYGPQCLCRGAGAAGG

SEQ ID NO: 217 - protein, 43 aa, Artificial Sequence
  Description of Artificial Sequence: Synthetic polypeptide
  MOD_RES (15)..(15): Citrulline
  MOD_RES (23)..(23): Citrulline
MCMPCFTTDHQMLRXCDDCCGGXGRGKCYGPQCLCRGAGAAGG

SEQ ID NO: 218 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
MCMPCFTTDHQMLRXCDDCCGGXGRGXCYGPQCLCRGAGAAGG

SEQ ID NO: 219 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCMPCFTTDHQMLRXCDDCCGGXGRGXCYGPQCLCRGAGAAGG

SEQ ID NO: 220 - protein, 43 aa, Artificial Sequence
  Description of Artificial Sequence: Synthetic polypeptide
  MOD_RES (15)..(15): Citrulline
  MOD_RES (23)..(23): Citrulline
LCLPCFTTDHQLLRXCDDCCGGXGRGKCYGPQCLCRGAGAAGG

SEQ ID NO: 221 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
LCLPCFTTDHQLLRXCDDCCGGXGRGXCYGPQCLCRGAGAAGG

SEQ ID NO: 222 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCLPCFTTDHQLLRXCDDCCGGXGRGXCYGPQCLCRGAGAAGG

SEQ ID NO: 223 - protein, 36 aa, Artificial Sequence
  Description of Artificial Sequence: Synthetic polypeptide
GCGPCFTTDHQGARKCDDCCGGKGRGKCYGPQCLCR

SEQ ID NO: 224 - protein, 36 aa, Artificial Sequence
  Description of Artificial Sequence: Synthetic polypeptide
GCGPCFTTDHQGARACDDCCGGKGRGKCYGPQCLCR

SEQ ID NO: 225 - protein, 36 aa, Artificial Sequence
  Description of Artificial Sequence: Synthetic polypeptide
GCGPCFTTDHQGARRCDDCCGGKGRGKCYGPQCLCR

SEQ ID NO: 226 - protein, 36 aa, Artificial Sequence
  Description of Artificial Sequence: Synthetic polypeptide
GCGPCFTTDHQGARKCDDCCGGAGRGKCYGPQCLCR

SEQ ID NO: 227 - protein, 36 aa, Artificial Sequence
  Description of Artificial Sequence: Synthetic polypeptide
GCGPCFTTDHQGARACDDCCGGAGRGKCYGPQCLCR

SEQ ID NO: 228 - protein, 36 aa, Artificial Sequence
  Description of Artificial Sequence: Synthetic polypeptide
GCGPCFTTDHQGARRCDDCCGGAGRGKCYGPQCLCR

SEQ ID NO: 229 - protein, 36 aa, Artificial Sequence
  Description of Artificial Sequence: Synthetic polypeptide
GCGPCFTTDHQGARKCDDCCGGRGRGKCYGPQCLCR

SEQ ID NO: 230 - protein, 36 aa, Artificial Sequence
  Description of Artificial Sequence: Synthetic polypeptide
GCGPCFTTDHQGARACDDCCGGRGRGKCYGPQCLCR

SEQ ID NO: 231 - protein, 36 aa, Artificial Sequence
  Description of Artificial Sequence: Synthetic polypeptide
GCGPCFTTDHQGARRCDDCCGGRGRGKCYGPQCLCR

SEQ ID NO: 232 - protein, 36 aa, Artificial Sequence
  Description of Artificial Sequence: Synthetic polypeptide
GCGPCFTTDHQGARKCDDCCGGKGRGACYGPQCLCR

SEQ ID NO: 233 - protein, 36 aa, Artificial Sequence
  Description of Artificial Sequence: Synthetic polypeptide
GCGPCFTTDHQGARACDDCCGGKGRGACYGPQCLCR

SEQ ID NO: 234 - protein, 36 aa, Artificial Sequence
  Description of Artificial Sequence: Synthetic polypeptide
GCGPCFTTDHQGARRCDDCCGGKGRGACYGPQCLCR

SEQ ID NO: 235 - protein, 36 aa, Artificial Sequence
  Description of Artificial Sequence: Synthetic polypeptide
GCGPCFTTDHQGARKCDDCCGGAGRGACYGPQCLCR

SEQ ID NO: 236 - protein, 36 aa, Artificial Sequence
  Description of Artificial Sequence: Synthetic polypeptide
GCGPCFTTDHQGARACDDCCGGAGRGACYGPQCLCR

SEQ ID NO: 237 - protein, 36 aa, Artificial Sequence
  Description of Artificial Sequence: Synthetic polypeptide
GCGPCFTTDHQGARRCDDCCGGAGRGACYGPQCLCR

SEQ ID NO: 238 - protein, 36 aa, Artificial Sequence
  Description of Artificial Sequence: Synthetic polypeptide
GCGPCFTTDHQGARKCDDCCGGRGRGACYGPQCLCR

SEQ ID NO: 239 - protein, 36 aa, Artificial Sequence
  Description of Artificial Sequence: Synthetic polypeptide
GCGPCFTTDHQGARACDDCCGGRGRGACYGPQCLCR

SEQ ID NO: 240 - protein, 36 aa, Artificial Sequence
  Description of Artificial Sequence: Synthetic polypeptide
GCGPCFTTDHQGARRCDDCCGGRGRGACYGPQCLCR

SEQ ID NO: 241 - protein, 36 aa, Artificial Sequence
  Description of Artificial Sequence: Synthetic polypeptide
GCGPCFTTDHQGARKCDDCCGGKGRGRCYGPQCLCR

SEQ ID NO: 242 - protein, 36 aa, Artificial Sequence
  Description of Artificial Sequence: Synthetic polypeptide
GCGPCFTTDHQGARACDDCCGGKGRGRCYGPQCLCR

SEQ ID NO: 243 - protein, 36 aa, Artificial Sequence
  Description of Artificial Sequence: Synthetic polypeptide
GCGPCFTTDHQGARRCDDCCGGKGRGRCYGPQCLCR

SEQ ID NO: 244 - protein, 36 aa, Artificial Sequence
  Description of Artificial Sequence: Synthetic polypeptide
GCGPCFTTDHQGARKCDDCCGGAGRGRCYGPQCLCR

SEQ ID NO: 245 - protein, 36 aa, Artificial Sequence
  Description of Artificial Sequence: Synthetic polypeptide
GCGPCFTTDHQGARACDDCCGGAGRGRCYGPQCLCR

SEQ ID NO: 246 - protein, 36 aa, Artificial Sequence
  Description of Artificial Sequence: Synthetic polypeptide
GCGPCFTTDHQGARRCDDCCGGAGRGRCYGPQCLCR

SEQ ID NO: 247 - protein, 36 aa, Artificial Sequence
  Description of Artificial Sequence: Synthetic polypeptide
GCGPCFTTDHQGARKCDDCCGGRGRGRCYGPQCLCR

SEQ ID NO: 248 - protein, 36 aa, Artificial Sequence
  Description of Artificial Sequence: Synthetic polypeptide
GCGPCFTTDHQGARACDDCCGGRGRGRCYGPQCLCR

SEQ ID NO: 249 - protein, 36 aa, Artificial Sequence
  Description of Artificial Sequence: Synthetic polypeptide
GCGPCFTTDHQGARRCDDCCGGRGRGRCYGPQCLCR

SEQ ID NO: 250 - protein, 36 aa, Artificial Sequence; identical to SEQ ID NO: 249
  Description of Artificial Sequence: Synthetic polypeptide

SEQ ID NO: 251 - protein, 36 aa, Artificial Sequence
  Description of Artificial Sequence: Synthetic polypeptide
KCGPCFTTDHQGARRCDDCCGGRGRGRCYGPQCLCR

SEQ ID NO: 252 - protein, 36 aa, Artificial Sequence; identical to SEQ ID NO: 30
  Description of Artificial Sequence: Synthetic polypeptide

SEQ ID NO: 253 - protein, 36 aa, Artificial Sequence; identical to SEQ ID NO: 31
  Description of Artificial Sequence: Synthetic polypeptide

SEQ ID NO: 254 - protein, 36 aa, Artificial Sequence
  Description of Artificial Sequence: Synthetic polypeptide
  MOD_RES (15)..(15): Citrulline
  MOD_RES (23)..(23): Citrulline
GCGPCFTTDHQGARXCDDCCGGXGRGKCYGPQCLCR

SEQ ID NO: 255 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
GCGPCFTTDHQGARXCDDCCGGXGRGXCYGPQCLCR

SEQ ID NO: 256 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCGPCFTTDHQGARXCDDCCGGXGRGXCYGPQCLCR

SEQ ID NO: 257 - protein, 36 aa, Artificial Sequence; identical to SEQ ID NO: 35
  Description of Artificial Sequence: Synthetic polypeptide
  MOD_RES (15)..(15): Citrulline
  MOD_RES (23)..(23): Citrulline

SEQ ID NO: 258 - protein, 36 aa, Artificial Sequence; identical to SEQ ID NO: 36
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 259 - protein, 36 aa, Artificial Sequence; identical to SEQ ID NO: 37
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 260 - protein, 36 aa, Artificial Sequence
  Description of Artificial Sequence: Synthetic polypeptide
ACAPCFTTDHQAARKCDDCCGGKGRGKCYGPQCLCR

SEQ ID NO: 261 - protein, 36 aa, Artificial Sequence
  Description of Artificial Sequence: Synthetic polypeptide
ACAPCFTTDHQAARACDDCCGGKGRGKCYGPQCLCR

SEQ ID NO: 262 - protein, 36 aa, Artificial Sequence
  Description of Artificial Sequence: Synthetic polypeptide
ACAPCFTTDHQAARRCDDCCGGKGRGKCYGPQCLCR

SEQ ID NO: 263 - protein, 36 aa, Artificial Sequence
  Description of Artificial Sequence: Synthetic polypeptide
ACAPCFTTDHQAARKCDDCCGGAGRGKCYGPQCLCR

SEQ ID NO: 264 - protein, 36 aa, Artificial Sequence
  Description of Artificial Sequence: Synthetic polypeptide
ACAPCFTTDHQAARACDDCCGGAGRGKCYGPQCLCR

SEQ ID NO: 265 - protein, 36 aa, Artificial Sequence
  Description of Artificial Sequence: Synthetic polypeptide
ACAPCFTTDHQAARRCDDCCGGAGRGKCYGPQCLCR

SEQ ID NO: 266 - protein, 36 aa, Artificial Sequence
  Description of Artificial Sequence: Synthetic polypeptide
ACAPCFTTDHQAARKCDDCCGGRGRGKCYGPQCLCR

SEQ ID NO: 267 - protein, 36 aa, Artificial Sequence
  Description of Artificial Sequence: Synthetic polypeptide
ACAPCFTTDHQAARACDDCCGGRGRGKCYGPQCLCR

SEQ ID NO: 268 - protein, 36 aa, Artificial Sequence
  Description of Artificial Sequence: Synthetic polypeptide
ACAPCFTTDHQAARRCDDCCGGRGRGKCYGPQCLCR

SEQ ID NO: 269 - protein, 36 aa, Artificial Sequence
  Description of Artificial Sequence: Synthetic polypeptide
ACAPCFTTDHQAARKCDDCCGGKGRGACYGPQCLCR

SEQ ID NO: 270 - protein, 36 aa, Artificial Sequence
  Description of Artificial Sequence: Synthetic polypeptide
ACAPCFTTDHQAARACDDCCGGKGRGACYGPQCLCR

SEQ ID NO: 271 - protein, 36 aa, Artificial Sequence
  Description of Artificial Sequence: Synthetic polypeptide
ACAPCFTTDHQAARRCDDCCGGKGRGACYGPQCLCR

SEQ ID NO: 272 - protein, 36 aa, Artificial Sequence
  Description of Artificial Sequence: Synthetic polypeptide
ACAPCFTTDHQAARKCDDCCGGAGRGACYGPQCLCR

SEQ ID NO: 273 - protein, 36 aa, Artificial Sequence
  Description of Artificial Sequence: Synthetic polypeptide
ACAPCFTTDHQAARACDDCCGGAGRGACYGPQCLCR

SEQ ID NO: 274 - protein, 36 aa, Artificial Sequence
  Description of Artificial Sequence: Synthetic polypeptide
ACAPCFTTDHQAARRCDDCCGGAGRGACYGPQCLCR

SEQ ID NO: 275 - protein, 36 aa, Artificial Sequence
  Description of Artificial Sequence: Synthetic polypeptide
ACAPCFTTDHQAARKCDDCCGGRGRGACYGPQCLCR

SEQ ID NO: 276 - protein, 36 aa, Artificial Sequence
  Description of Artificial Sequence: Synthetic polypeptide
ACAPCFTTDHQAARACDDCCGGRGRGACYGPQCLCR

SEQ ID NO: 277 - protein, 36 aa, Artificial Sequence
  Description of Artificial Sequence: Synthetic polypeptide
ACAPCFTTDHQAARRCDDCCGGRGRGACYGPQCLCR

SEQ ID NO: 278 - protein, 36 aa, Artificial Sequence
  Description of Artificial Sequence: Synthetic polypeptide
ACAPCFTTDHQAARKCDDCCGGKGRGRCYGPQCLCR

SEQ ID NO: 279 - protein, 36 aa, Artificial Sequence
  Description of Artificial Sequence: Synthetic polypeptide
ACAPCFTTDHQAARACDDCCGGKGRGRCYGPQCLCR

SEQ ID NO: 280 - protein, 36 aa, Artificial Sequence
  Description of Artificial Sequence: Synthetic polypeptide
ACAPCFTTDHQAARRCDDCCGGKGRGRCYGPQCLCR

SEQ ID NO: 281 - protein, 36 aa, Artificial Sequence
  Description of Artificial Sequence: Synthetic polypeptide
ACAPCFTTDHQAARKCDDCCGGAGRGRCYGPQCLCR

SEQ ID NO: 282 - protein, 36 aa, Artificial Sequence
  Description of Artificial Sequence: Synthetic polypeptide
ACAPCFTTDHQAARACDDCCGGAGRGRCYGPQCLCR

SEQ ID NO: 283 - protein, 36 aa, Artificial Sequence
  Description of Artificial Sequence: Synthetic polypeptide
ACAPCFTTDHQAARRCDDCCGGAGRGRCYGPQCLCR

SEQ ID NO: 284 - protein, 36 aa, Artificial Sequence
  Description of Artificial Sequence: Synthetic polypeptide
ACAPCFTTDHQAARKCDDCCGGRGRGRCYGPQCLCR

SEQ ID NO: 285 - protein, 36 aa, Artificial Sequence
  Description of Artificial Sequence: Synthetic polypeptide
ACAPCFTTDHQAARACDDCCGGRGRGRCYGPQCLCR

SEQ ID NO: 286 - protein, 36 aa, Artificial Sequence; identical to SEQ ID NO: 30
  Description of Artificial Sequence: Synthetic polypeptide

SEQ ID NO: 287 - protein, 36 aa, Artificial Sequence; identical to SEQ ID NO: 30
  Description of Artificial Sequence: Synthetic polypeptide

SEQ ID NO: 288 - protein, 36 aa, Artificial Sequence; identical to SEQ ID NO: 31
  Description of Artificial Sequence: Synthetic polypeptide

SEQ ID NO: 289 - protein, 36 aa, Artificial Sequence; identical to SEQ ID NO: 30
  Description of Artificial Sequence: Synthetic polypeptide

SEQ ID NO: 290 - protein, 36 aa, Artificial Sequence; identical to SEQ ID NO: 31
  Description of Artificial Sequence: Synthetic polypeptide

SEQ ID NO: 291 - protein, 36 aa, Artificial Sequence; identical to SEQ ID NO: 35
  Description of Artificial Sequence: Synthetic polypeptide
  MOD_RES (15)..(15): Citrulline
  MOD_RES (23)..(23): Citrulline

SEQ ID NO: 292 - protein, 36 aa, Artificial Sequence; identical to SEQ ID NO: 36
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 293 - protein, 36 aa, Artificial Sequence; identical to SEQ ID NO: 37
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 294 - protein, 36 aa, Artificial Sequence; identical to SEQ ID NO: 35
  Description of Artificial Sequence: Synthetic polypeptide
  MOD_RES (15)..(15): Citrulline
  MOD_RES (23)..(23): Citrulline

SEQ ID NO: 295 - protein, 36 aa, Artificial Sequence; identical to SEQ ID NO: 36
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 296 - protein, 36 aa, Artificial Sequence; identical to SEQ ID NO: 37
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 297 - protein, 36 aa, Artificial Sequence
  Description of Artificial Sequence: Synthetic polypeptide
ICIPCFTTDHQIARKCDDCCGGKGRGKCYGPQCLCR

SEQ ID NO: 298 - protein, 36 aa, Artificial Sequence
  Description of Artificial Sequence: Synthetic polypeptide
ICIPCFTTDHQIARACDDCCGGKGRGKCYGPQCLCR

SEQ ID NO: 299 - protein, 36 aa, Artificial Sequence
  Description of Artificial Sequence: Synthetic polypeptide
ICIPCFTTDHQIARRCDDCCGGKGRGKCYGPQCLCR

SEQ ID NO: 300 - protein, 36 aa, Artificial Sequence
  Description of Artificial Sequence: Synthetic polypeptide
ICIPCFTTDHQIARKCDDCCGGAGRGKCYGPQCLCR

SEQ ID NO: 301 - protein, 36 aa, Artificial Sequence
  Description of Artificial Sequence: Synthetic polypeptide
ICIPCFTTDHQIARACDDCCGGAGRGKCYGPQCLCR

SEQ ID NO: 302 - protein, 36 aa, Artificial Sequence
  Description of Artificial Sequence: Synthetic polypeptide
ICIPCFTTDHQIARRCDDCCGGAGRGKCYGPQCLCR

SEQ ID NO: 303 - protein, 36 aa, Artificial Sequence
  Description of Artificial Sequence: Synthetic polypeptide
ICIPCFTTDHQIARKCDDCCGGRGRGKCYGPQCLCR

SEQ ID NO: 304 - protein, 36 aa, Artificial Sequence
  Description of Artificial Sequence: Synthetic polypeptide
ICIPCFTTDHQIARACDDCCGGRGRGKCYGPQCLCR

SEQ ID NO: 305 - protein, 36 aa, Artificial Sequence
  Description of Artificial Sequence: Synthetic polypeptide
ICIPCFTTDHQIARRCDDCCGGRGRGKCYGPQCLCR

SEQ ID NO: 306 - protein, 36 aa, Artificial Sequence
  Description of Artificial Sequence: Synthetic polypeptide
ICIPCFTTDHQIARKCDDCCGGKGRGACYGPQCLCR

SEQ ID NO: 307 - protein, 36 aa, Artificial Sequence
  Description of Artificial Sequence: Synthetic polypeptide
ICIPCFTTDHQIARACDDCCGGKGRGACYGPQCLCR

SEQ ID NO: 308 - protein, 36 aa, Artificial Sequence
  Description of Artificial Sequence: Synthetic polypeptide
ICIPCFTTDHQIARRCDDCCGGKGRGACYGPQCLCR

SEQ ID NO: 309 - protein, 36 aa, Artificial Sequence
  Description of Artificial Sequence: Synthetic polypeptide
ICIPCFTTDHQIARKCDDCCGGAGRGACYGPQCLCR

SEQ ID NO: 310 - protein, 36 aa, Artificial Sequence
  Description of Artificial Sequence: Synthetic polypeptide
ICIPCFTTDHQIARACDDCCGGAGRGACYGPQCLCR

SEQ ID NO: 311 - protein, 36 aa, Artificial Sequence
  Description of Artificial Sequence: Synthetic polypeptide
ICIPCFTTDHQIARRCDDCCGGAGRGACYGPQCLCR

SEQ ID NO: 312 - protein, 36 aa, Artificial Sequence
  Description of Artificial Sequence: Synthetic polypeptide
ICIPCFTTDHQIARKCDDCCGGRGRGACYGPQCLCR

SEQ ID NO: 313 - protein, 36 aa, Artificial Sequence
  Description of Artificial Sequence: Synthetic polypeptide
ICIPCFTTDHQIARACDDCCGGRGRGACYGPQCLCR

SEQ ID NO: 314 - protein, 36 aa, Artificial Sequence
  Description of Artificial Sequence: Synthetic polypeptide
ICIPCFTTDHQIARRCDDCCGGRGRGACYGPQCLCR

SEQ ID NO: 315 - protein, 36 aa, Artificial Sequence
  Description of Artificial Sequence: Synthetic polypeptide
ICIPCFTTDHQIARKCDDCCGGKGRGRCYGPQCLCR

SEQ ID NO: 316 - protein, 36 aa, Artificial Sequence
  Description of Artificial Sequence: Synthetic polypeptide
ICIPCFTTDHQIARACDDCCGGKGRGRCYGPQCLCR

SEQ ID NO: 317 - protein, 36 aa, Artificial Sequence
  Description of Artificial Sequence: Synthetic polypeptide
ICIPCFTTDHQIARRCDDCCGGKGRGRCYGPQCLCR

SEQ ID NO: 318 - protein, 36 aa, Artificial Sequence
  Description of Artificial Sequence: Synthetic polypeptide
ICIPCFTTDHQIARKCDDCCGGAGRGRCYGPQCLCR

SEQ ID NO: 319 - protein, 36 aa, Artificial Sequence
  Description of Artificial Sequence: Synthetic polypeptide
ICIPCFTTDHQIARACDDCCGGAGRGRCYGPQCLCR

SEQ ID NO: 320 - protein, 36 aa, Artificial Sequence
  Description of Artificial Sequence: Synthetic polypeptide
ICIPCFTTDHQIARRCDDCCGGAGRGRCYGPQCLCR

SEQ ID NO: 321 - protein, 36 aa, Artificial Sequence
  Description of Artificial Sequence: Synthetic polypeptide
ICIPCFTTDHQIARKCDDCCGGRGRGRCYGPQCLCR

SEQ ID NO: 322 - protein, 36 aa, Artificial Sequence
  Description of Artificial Sequence: Synthetic polypeptide
ICIPCFTTDHQIARACDDCCGGRGRGRCYGPQCLCR

SEQ ID NO: 323 - protein, 36 aa, Artificial Sequence
  Description of Artificial Sequence: Synthetic polypeptide
ICIPCFTTDHQIARRCDDCCGGRGRGRCYGPQCLCR

SEQ ID NO: 324 - protein, 36 aa, Artificial Sequence; identical to SEQ ID NO: 323
  Description of Artificial Sequence: Synthetic polypeptide

SEQ ID NO: 325 - protein, 36 aa, Artificial Sequence
  Description of Artificial Sequence: Synthetic polypeptide
KCIPCFTTDHQIARRCDDCCGGRGRGRCYGPQCLCR

SEQ ID NO: 326 - protein, 36 aa, Artificial Sequence; identical to SEQ ID NO: 30
  Description of Artificial Sequence: Synthetic polypeptide

SEQ ID NO: 327 - protein, 36 aa, Artificial Sequence; identical to SEQ ID NO: 31
  Description of Artificial Sequence: Synthetic polypeptide

SEQ ID NO: 328 - protein, 36 aa, Artificial Sequence
  Description of Artificial Sequence: Synthetic polypeptide
  MOD_RES (15)..(15): Citrulline
  MOD_RES (23)..(23): Citrulline
ICIPCFTTDHQIARXCDDCCGGXGRGKCYGPQCLCR

SEQ ID NO: 329 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
ICIPCFTTDHQIARXCDDCCGGXGRGXCYGPQCLCR

SEQ ID NO: 330 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCIPCFTTDHQIARXCDDCCGGXGRGXCYGPQCLCR

SEQ ID NO: 331 - protein, 36 aa, Artificial Sequence; identical to SEQ ID NO: 35
  Description of Artificial Sequence: Synthetic polypeptide
  MOD_RES (15)..(15): Citrulline
  MOD_RES (23)..(23): Citrulline

SEQ ID NO: 332 - protein, 36 aa, Artificial Sequence; identical to SEQ ID NO: 36
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 333 - protein, 36 aa, Artificial Sequence; identical to SEQ ID NO: 37
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 334 - protein, 36 aa, Artificial Sequence
  Description of Artificial Sequence: Synthetic polypeptide
TCTPCFTTDHQTARKCDDCCGGKGRGKCYGPQCLCR

SEQ ID NO: 335 - protein, 36 aa, Artificial Sequence
  Description of Artificial Sequence: Synthetic polypeptide
TCTPCFTTDHQTARACDDCCGGKGRGKCYGPQCLCR

SEQ ID NO: 336 - protein, 36 aa, Artificial Sequence
  Description of Artificial Sequence: Synthetic polypeptide
TCTPCFTTDHQTARRCDDCCGGKGRGKCYGPQCLCR

SEQ ID NO: 337 - protein, 36 aa, Artificial Sequence
  Description of Artificial Sequence: Synthetic polypeptide
TCTPCFTTDHQTARKCDDCCGGAGRGKCYGPQCLCR

SEQ ID NO: 338 - protein, 36 aa, Artificial Sequence
  Description of Artificial Sequence: Synthetic polypeptide
TCTPCFTTDHQTARACDDCCGGAGRGKCYGPQCLCR

SEQ ID NO: 339 - protein, 36 aa, Artificial Sequence
  Description of Artificial Sequence: Synthetic polypeptide
TCTPCFTTDHQTARRCDDCCGGAGRGKCYGPQCLCR

SEQ ID NO: 340 - protein, 36 aa, Artificial Sequence
  Description of Artificial Sequence: Synthetic polypeptide
TCTPCFTTDHQTARKCDDCCGGRGRGKCYGPQCLCR

SEQ ID NO: 341 - protein, 36 aa, Artificial Sequence
  Description of Artificial Sequence: Synthetic polypeptide
TCTPCFTTDHQTARACDDCCGGRGRGKCYGPQCLCR

SEQ ID NO: 342 - protein, 36 aa, Artificial Sequence
  Description of Artificial Sequence: Synthetic polypeptide
TCTPCFTTDHQTARRCDDCCGGRGRGKCYGPQCLCR

SEQ ID NO: 343 - protein, 36 aa, Artificial Sequence
  Description of Artificial Sequence: Synthetic polypeptide
TCTPCFTTDHQTARKCDDCCGGKGRGACYGPQCLCR

SEQ ID NO: 344 - protein, 36 aa, Artificial Sequence
  Description of Artificial Sequence: Synthetic polypeptide
TCTPCFTTDHQTARACDDCCGGKGRGACYGPQCLCR

SEQ ID NO: 345 - protein, 36 aa, Artificial Sequence
  Description of Artificial Sequence: Synthetic polypeptide
TCTPCFTTDHQTARRCDDCCGGKGRGACYGPQCLCR

SEQ ID NO: 346 - protein, 36 aa, Artificial Sequence
  Description of Artificial Sequence: Synthetic polypeptide
TCTPCFTTDHQTARKCDDCCGGAGRGACYGPQCLCR

SEQ ID NO: 347 - protein, 36 aa, Artificial Sequence
  Description of Artificial Sequence: Synthetic polypeptide
TCTPCFTTDHQTARACDDCCGGAGRGACYGPQCLCR

SEQ ID NO: 348 - protein, 36 aa, Artificial Sequence
  Description of Artificial Sequence: Synthetic polypeptide
TCTPCFTTDHQTARRCDDCCGGAGRGACYGPQCLCR

SEQ ID NO: 349 - protein, 36 aa, Artificial Sequence
  Description of Artificial Sequence: Synthetic polypeptide
TCTPCFTTDHQTARKCDDCCGGRGRGACYGPQCLCR

SEQ ID NO: 350 - protein, 36 aa, Artificial Sequence
  Description of Artificial Sequence: Synthetic polypeptide
TCTPCFTTDHQTARACDDCCGGRGRGACYGPQCLCR

SEQ ID NO: 351 - protein, 36 aa, Artificial Sequence
  Description of Artificial Sequence: Synthetic polypeptide
TCTPCFTTDHQTARRCDDCCGGRGRGACYGPQCLCR

SEQ ID NO: 352 - protein, 36 aa, Artificial Sequence
  Description of Artificial Sequence: Synthetic polypeptide
TCTPCFTTDHQTARKCDDCCGGKGRGRCYGPQCLCR

SEQ ID NO: 353 - protein, 36 aa, Artificial Sequence
  Description of Artificial Sequence: Synthetic polypeptide
TCTPCFTTDHQTARACDDCCGGKGRGRCYGPQCLCR

SEQ ID NO: 354 - protein, 36 aa, Artificial Sequence
  Description of Artificial Sequence: Synthetic polypeptide
TCTPCFTTDHQTARRCDDCCGGKGRGRCYGPQCLCR

SEQ ID NO: 355 - protein, 36 aa, Artificial Sequence
  Description of Artificial Sequence: Synthetic polypeptide
TCTPCFTTDHQTARKCDDCCGGAGRGRCYGPQCLCR

SEQ ID NO: 356 - protein, 36 aa, Artificial Sequence
  Description of Artificial Sequence: Synthetic polypeptide
TCTPCFTTDHQTARACDDCCGGAGRGRCYGPQCLCR

SEQ ID NO: 357 - protein, 36 aa, Artificial Sequence
  Description of Artificial Sequence: Synthetic polypeptide
TCTPCFTTDHQTARRCDDCCGGAGRGRCYGPQCLCR

SEQ ID NO: 358 - protein, 36 aa, Artificial Sequence
  Description of Artificial Sequence: Synthetic polypeptide
TCTPCFTTDHQTARKCDDCCGGRGRGRCYGPQCLCR

SEQ ID NO: 359 - protein, 36 aa, Artificial Sequence
  Description of Artificial Sequence: Synthetic polypeptide
TCTPCFTTDHQTARACDDCCGGRGRGRCYGPQCLCR

SEQ ID NO: 360 - protein, 36 aa, Artificial Sequence
  Description of Artificial Sequence: Synthetic polypeptide
TCTPCFTTDHQTARRCDDCCGGRGRGRCYGPQCLCR

SEQ ID NO: 361 - protein, 36 aa, Artificial Sequence; identical to SEQ ID NO: 360
  Description of Artificial Sequence: Synthetic polypeptide

SEQ ID NO: 362 - protein, 36 aa, Artificial Sequence
  Description of Artificial Sequence: Synthetic polypeptide
KCTPCFTTDHQTARRCDDCCGGRGRGRCYGPQCLCR

SEQ ID NO: 363 - protein, 36 aa, Artificial Sequence; identical to SEQ ID NO: 30
  Description of Artificial Sequence: Synthetic polypeptide

SEQ ID NO: 364 - protein, 36 aa, Artificial Sequence; identical to SEQ ID NO: 31
  Description of Artificial Sequence: Synthetic polypeptide

SEQ ID NO: 365 - protein, 36 aa, Artificial Sequence
  Description of Artificial Sequence: Synthetic polypeptide
  MOD_RES (15)..(15): Citrulline
  MOD_RES (23)..(23): Citrulline
TCTPCFTTDHQTARXCDDCCGGXGRGKCYGPQCLCR

SEQ ID NO: 366 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
TCTPCFTTDHQTARXCDDCCGGXGRGXCYGPQCLCR

SEQ ID NO: 367 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCTPCFTTDHQTARXCDDCCGGXGRGXCYGPQCLCR

SEQ ID NO: 368 - protein, 36 aa, Artificial Sequence; identical to SEQ ID NO: 35
  Description of Artificial Sequence: Synthetic polypeptide
  MOD_RES (15)..(15): Citrulline
  MOD_RES (23)..(23): Citrulline

SEQ ID NO: 369 - protein, 36 aa, Artificial Sequence; identical to SEQ ID NO: 36
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 370 - protein, 36 aa, Artificial Sequence; identical to SEQ ID NO: 37
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 371 - protein, 36 aa, Artificial Sequence
  Description of Artificial Sequence: Synthetic polypeptide
VCVPCFTTDHQVARKCDDCCGGKGRGKCYGPQCLCR

SEQ ID NO: 372 - protein, 36 aa, Artificial Sequence
  Description of Artificial Sequence: Synthetic polypeptide
VCVPCFTTDHQVARACDDCCGGKGRGKCYGPQCLCR

SEQ ID NO: 373 - protein, 36 aa, Artificial Sequence
  Description of Artificial Sequence: Synthetic polypeptide
VCVPCFTTDHQVARRCDDCCGGKGRGKCYGPQCLCR

SEQ ID NO: 374 - protein, 36 aa, Artificial Sequence
  Description of Artificial Sequence: Synthetic polypeptide
VCVPCFTTDHQVARKCDDCCGGAGRGKCYGPQCLCR

SEQ ID NO: 375 - protein, 36 aa, Artificial Sequence
  Description of Artificial Sequence: Synthetic polypeptide
VCVPCFTTDHQVARACDDCCGGAGRGKCYGPQCLCR

SEQ ID NO: 376 - protein, 36 aa, Artificial Sequence
  Description of Artificial Sequence: Synthetic polypeptide
VCVPCFTTDHQVARRCDDCCGGAGRGKCYGPQCLCR

SEQ ID NO: 377 - protein, 36 aa, Artificial Sequence
  Description of Artificial Sequence: Synthetic polypeptide
VCVPCFTTDHQVARKCDDCCGGRGRGKCYGPQCLCR

SEQ ID NO: 378 - protein, 36 aa, Artificial Sequence
  Description of Artificial Sequence: Synthetic polypeptide
VCVPCFTTDHQVARACDDCCGGRGRGKCYGPQCLCR

SEQ ID NO: 379 - protein, 36 aa, Artificial Sequence
  Description of Artificial Sequence: Synthetic polypeptide
VCVPCFTTDHQVARRCDDCCGGRGRGKCYGPQCLCR

SEQ ID NO: 380 - protein, 36 aa, Artificial Sequence
  Description of Artificial Sequence: Synthetic polypeptide
VCVPCFTTDHQVARKCDDCCGGKGRGACYGPQCLCR

SEQ ID NO: 381 - protein, 36 aa, Artificial Sequence
  Description of Artificial Sequence: Synthetic polypeptide
VCVPCFTTDHQVARACDDCCGGKGRGACYGPQCLCR

SEQ ID NO: 382 - protein, 36 aa, Artificial Sequence
  Description of Artificial Sequence: Synthetic polypeptide
VCVPCFTTDHQVARRCDDCCGGKGRGACYGPQCLCR

SEQ ID NO: 383 - protein, 36 aa, Artificial Sequence
  Description of Artificial Sequence: Synthetic polypeptide
VCVPCFTTDHQVARKCDDCCGGAGRGACYGPQCLCR

SEQ ID NO: 384 - protein, 36 aa, Artificial Sequence
  Description of Artificial Sequence: Synthetic polypeptide
VCVPCFTTDHQVARACDDCCGGAGRGACYGPQCLCR

SEQ ID NO: 385 - protein, 36 aa, Artificial Sequence
  Description of Artificial Sequence: Synthetic polypeptide
VCVPCFTTDHQVARRCDDCCGGAGRGACYGPQCLCR

SEQ ID NO: 386 - protein, 36 aa, Artificial Sequence
  Description of Artificial Sequence: Synthetic polypeptide
VCVPCFTTDHQVARKCDDCCGGRGRGACYGPQCLCR

SEQ ID NO: 387 - protein, 36 aa, Artificial Sequence
  Description of Artificial Sequence: Synthetic polypeptide
VCVPCFTTDHQVARACDDCCGGRGRGACYGPQCLCR

SEQ ID NO: 388 - protein, 36 aa, Artificial Sequence
  Description of Artificial Sequence: Synthetic polypeptide
VCVPCFTTDHQVARRCDDCCGGRGRGACYGPQCLCR

SEQ ID NO: 389 - protein, 36 aa, Artificial Sequence
  Description of Artificial Sequence: Synthetic polypeptide
VCVPCFTTDHQVARKCDDCCGGKGRGRCYGPQCLCR

SEQ ID NO: 390 - protein, 36 aa, Artificial Sequence
  Description of Artificial Sequence: Synthetic polypeptide
VCVPCFTTDHQVARACDDCCGGKGRGRCYGPQCLCR

SEQ ID NO: 391 - protein, 36 aa, Artificial Sequence
  Description of Artificial Sequence: Synthetic polypeptide
VCVPCFTTDHQVARRCDDCCGGKGRGRCYGPQCLCR

SEQ ID NO: 392 - protein, 36 aa, Artificial Sequence
  Description of Artificial Sequence: Synthetic polypeptide
VCVPCFTTDHQVARKCDDCCGGAGRGRCYGPQCLCR

SEQ ID NO: 393 - protein, 36 aa, Artificial Sequence
  Description of Artificial Sequence: Synthetic polypeptide
VCVPCFTTDHQVARACDDCCGGAGRGRCYGPQCLCR

SEQ ID NO: 394 - protein, 36 aa, Artificial Sequence
  Description of Artificial Sequence: Synthetic polypeptide
VCVPCFTTDHQVARRCDDCCGGAGRGRCYGPQCLCR

SEQ ID NO: 395 - protein, 36 aa, Artificial Sequence
  Description of Artificial Sequence: Synthetic polypeptide
VCVPCFTTDHQVARKCDDCCGGRGRGRCYGPQCLCR

SEQ ID NO: 396 - protein, 36 aa, Artificial Sequence
  Description of Artificial Sequence: Synthetic polypeptide
VCVPCFTTDHQVARACDDCCGGRGRGRCYGPQCLCR

SEQ ID NO: 397 - protein, 36 aa, Artificial Sequence
  Description of Artificial Sequence: Synthetic polypeptide
VCVPCFTTDHQVARRCDDCCGGRGRGRCYGPQCLCR

SEQ ID NO: 398 - protein, 36 aa, Artificial Sequence; identical to SEQ ID NO: 397
  Description of Artificial Sequence: Synthetic polypeptide

SEQ ID NO: 399 - protein, 36 aa, Artificial Sequence
  Description of Artificial Sequence: Synthetic polypeptide
KCVPCFTTDHQVARRCDDCCGGRGRGRCYGPQCLCR

SEQ ID NO: 400 - protein, 36 aa, Artificial Sequence; identical to SEQ ID NO: 30
  Description of Artificial Sequence: Synthetic polypeptide

SEQ ID NO: 401 - protein, 36 aa, Artificial Sequence; identical to SEQ ID NO: 31
  Description of Artificial Sequence: Synthetic polypeptide

SEQ ID NO: 402 - protein, 36 aa, Artificial Sequence
  Description of Artificial Sequence: Synthetic polypeptide
  MOD_RES (15)..(15): Citrulline
  MOD_RES (23)..(23): Citrulline
VCVPCFTTDHQVARXCDDCCGGXGRGKCYGPQCLCR

SEQ ID NO: 403 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
VCVPCFTTDHQVARXCDDCCGGXGRGXCYGPQCLCR

SEQ ID NO: 404 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCVPCFTTDHQVARXCDDCCGGXGRGXCYGPQCLCR

SEQ ID NO: 405 - protein, 36 aa, Artificial Sequence; identical to SEQ ID NO: 35
  Description of Artificial Sequence: Synthetic polypeptide
  MOD_RES (15)..(15): Citrulline
  MOD_RES (23)..(23): Citrulline

SEQ ID NO: 406 - protein, 36 aa, Artificial Sequence; identical to SEQ ID NO: 36
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 407 - protein, 36 aa, Artificial Sequence; identical to SEQ ID NO: 37
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 408 - protein, 36 aa, Artificial Sequence
  Description of Artificial Sequence: Synthetic polypeptide
LCLPCFTTDHQLARKCDDCCGGKGRGKCYGPQCLCR

SEQ ID NO: 409 - protein, 36 aa, Artificial Sequence
  Description of Artificial Sequence: Synthetic polypeptide
LCLPCFTTDHQLARACDDCCGGKGRGKCYGPQCLCR

SEQ ID NO: 410 - protein, 36 aa, Artificial Sequence
  Description of Artificial Sequence: Synthetic polypeptide
LCLPCFTTDHQLARRCDDCCGGKGRGKCYGPQCLCR

SEQ ID NO: 411 - protein, 36 aa, Artificial Sequence
  Description of Artificial Sequence: Synthetic polypeptide
LCLPCFTTDHQLARKCDDCCGGAGRGKCYGPQCLCR

SEQ ID NO: 412 - protein, 36 aa, Artificial Sequence
  Description of Artificial Sequence: Synthetic polypeptide
LCLPCFTTDHQLARACDDCCGGAGRGKCYGPQCLCR

SEQ ID NO: 413 - protein, 36 aa, Artificial Sequence
  Description of Artificial Sequence: Synthetic polypeptide
LCLPCFTTDHQLARRCDDCCGGAGRGKCYGPQCLCR

SEQ ID NO: 414 - protein, 36 aa, Artificial Sequence
  Description of Artificial Sequence: Synthetic polypeptide
LCLPCFTTDHQLARKCDDCCGGRGRGKCYGPQCLCR

SEQ ID NO: 415 - protein, 36 aa, Artificial Sequence
  Description of Artificial Sequence: Synthetic polypeptide
LCLPCFTTDHQLARACDDCCGGRGRGKCYGPQCLCR

SEQ ID NO: 416 - protein, 36 aa, Artificial Sequence
  Description of Artificial Sequence: Synthetic polypeptide
LCLPCFTTDHQLARRCDDCCGGRGRGKCYGPQCLCR

SEQ ID NO: 417 - protein, 36 aa, Artificial Sequence
  Description of Artificial Sequence: Synthetic polypeptide
LCLPCFTTDHQLARKCDDCCGGKGRGACYGPQCLCR

SEQ ID NO: 418 - protein, 36 aa, Artificial Sequence
  Description of Artificial Sequence: Synthetic polypeptide
LCLPCFTTDHQLARACDDCCGGKGRGACYGPQCLCR

SEQ ID NO: 419 - protein, 36 aa, Artificial Sequence
  Description of Artificial Sequence: Synthetic polypeptide
LCLPCFTTDHQLARRCDDCCGGKGRGACYGPQCLCR

SEQ ID NO: 420 - protein, 36 aa, Artificial Sequence
  Description of Artificial Sequence: Synthetic polypeptide
LCLPCFTTDHQLARKCDDCCGGAGRGACYGPQCLCR

SEQ ID NO: 421 - protein, 36 aa, Artificial Sequence
  Description of Artificial Sequence: Synthetic polypeptide
LCLPCFTTDHQLARACDDCCGGAGRGACYGPQCLCR

SEQ ID NO: 422 - protein, 36 aa, Artificial Sequence
  Description of Artificial Sequence: Synthetic polypeptide
LCLPCFTTDHQLARRCDDCCGGAGRGACYGPQCLCR

SEQ ID NO: 423 - protein, 36 aa, Artificial Sequence
  Description of Artificial Sequence: Synthetic polypeptide
LCLPCFTTDHQLARKCDDCCGGRGRGACYGPQCLCR

SEQ ID NO: 424 - protein, 36 aa, Artificial Sequence
  Description of Artificial Sequence: Synthetic polypeptide
LCLPCFTTDHQLARACDDCCGGRGRGACYGPQCLCR

SEQ ID NO: 425 - protein, 36 aa, Artificial Sequence
  Description of Artificial Sequence: Synthetic polypeptide
LCLPCFTTDHQLARRCDDCCGGRGRGACYGPQCLCR

SEQ ID NO: 426 - protein, 36 aa, Artificial Sequence
  Description of Artificial Sequence: Synthetic polypeptide
LCLPCFTTDHQLARKCDDCCGGKGRGRCYGPQCLCR

SEQ ID NO: 427 - protein, 36 aa, Artificial Sequence
  Description of Artificial Sequence: Synthetic polypeptide
LCLPCFTTDHQLARACDDCCGGKGRGRCYGPQCLCR

SEQ ID NO: 428 - protein, 36 aa, Artificial Sequence
  Description of Artificial Sequence: Synthetic polypeptide
LCLPCFTTDHQLARRCDDCCGGKGRGRCYGPQCLCR

SEQ ID NO: 429 - protein, 36 aa, Artificial Sequence
  Description of Artificial Sequence: Synthetic polypeptide
LCLPCFTTDHQLARKCDDCCGGAGRGRCYGPQCLCR

SEQ ID NO: 430 - protein, 36 aa, Artificial Sequence
  Description of Artificial Sequence: Synthetic polypeptide
LCLPCFTTDHQLARACDDCCGGAGRGRCYGPQCLCR

SEQ ID NO: 431 - protein, 36 aa, Artificial Sequence
  Description of Artificial Sequence: Synthetic polypeptide
LCLPCFTTDHQLARRCDDCCGGAGRGRCYGPQCLCR

SEQ ID NO: 432 - protein, 36 aa, Artificial Sequence
  Description of Artificial Sequence: Synthetic polypeptide
LCLPCFTTDHQLARKCDDCCGGRGRGRCYGPQCLCR

SEQ ID NO: 433 - protein, 36 aa, Artificial Sequence
  Description of Artificial Sequence: Synthetic polypeptide
LCLPCFTTDHQLARACDDCCGGRGRGRCYGPQCLCR

SEQ ID NO: 434 - protein, 36 aa, Artificial Sequence
  Description of Artificial Sequence: Synthetic polypeptide
LCLPCFTTDHQLARRCDDCCGGRGRGRCYGPQCLCR

SEQ ID NO: 435 - protein, 36 aa, Artificial Sequence; identical to SEQ ID NO: 434
  Description of Artificial Sequence: Synthetic polypeptide

SEQ ID NO: 436 - protein, 36 aa, Artificial Sequence
  Description of Artificial Sequence: Synthetic polypeptide
KCLPCFTTDHQLARRCDDCCGGRGRGRCYGPQCLCR

SEQ ID NO: 437 - protein, 36 aa, Artificial Sequence; identical to SEQ ID NO: 30
  Description of Artificial Sequence: Synthetic polypeptide

SEQ ID NO: 438 - protein, 36 aa, Artificial Sequence; identical to SEQ ID NO: 31
  Description of Artificial Sequence: Synthetic polypeptide

SEQ ID NO: 439 - protein, 36 aa, Artificial Sequence
  Description of Artificial Sequence: Synthetic polypeptide
  MOD_RES (15)..(15): Citrulline
  MOD_RES (23)..(23): Citrulline
LCLPCFTTDHQLARXCDDCCGGXGRGKCYGPQCLCR

SEQ ID NO: 440 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
LCLPCFTTDHQLARXCDDCCGGXGRGXCYGPQCLCR

SEQ ID NO: 441 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCLPCFTTDHQLARXCDDCCGGXGRGXCYGPQCLCR

SEQ ID NO: 442 - protein, 36 aa, Artificial Sequence; identical to SEQ ID NO: 35
  Description of Artificial Sequence: Synthetic polypeptide
  MOD_RES (15)..(15): Citrulline
  MOD_RES (23)..(23): Citrulline

SEQ ID NO: 443 - protein, 36 aa, Artificial Sequence; identical to SEQ ID NO: 36
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 444 - protein, 36 aa, Artificial Sequence; identical to SEQ ID NO: 37
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 445 - protein, 36 aa, Artificial Sequence
  Description of Artificial Sequence: Synthetic polypeptide
SCSPCFTTDHQSARKCDDCCGGKGRGKCYGPQCLCR

SEQ ID NO: 446 - protein, 36 aa, Artificial Sequence
  Description of Artificial Sequence: Synthetic polypeptide
SCSPCFTTDHQSARACDDCCGGKGRGKCYGPQCLCR

SEQ ID NO: 447 - protein, 36 aa, Artificial Sequence
  Description of Artificial Sequence: Synthetic polypeptide
SCSPCFTTDHQSARRCDDCCGGKGRGKCYGPQCLCR

SEQ ID NO: 448 - protein, 36 aa, Artificial Sequence
  Description of Artificial Sequence: Synthetic polypeptide
SCSPCFTTDHQSARKCDDCCGGAGRGKCYGPQCLCR

SEQ ID NO: 449 - protein, 36 aa, Artificial Sequence
  Description of Artificial Sequence: Synthetic polypeptide
SCSPCFTTDHQSARACDDCCGGAGRGKCYGPQCLCR

SEQ ID NO: 450 - protein, 36 aa, Artificial Sequence
  Description of Artificial Sequence: Synthetic polypeptide
SCSPCFTTDHQSARRCDDCCGGAGRGKCYGPQCLCR

SEQ ID NO: 451 - protein, 36 aa, Artificial Sequence
  Description of Artificial Sequence: Synthetic polypeptide
SCSPCFTTDHQSARKCDDCCGGRGRGKCYGPQCLCR

SEQ ID NO: 452 - protein, 36 aa, Artificial Sequence
  Description of Artificial Sequence: Synthetic polypeptide
SCSPCFTTDHQSARACDDCCGGRGRGKCYGPQCLCR

SEQ ID NO: 453 - protein, 36 aa, Artificial Sequence
  Description of Artificial Sequence: Synthetic polypeptide
SCSPCFTTDHQSARRCDDCCGGRGRGKCYGPQCLCR

SEQ ID NO: 454 - protein, 36 aa, Artificial Sequence
  Description of Artificial Sequence: Synthetic polypeptide
SCSPCFTTDHQSARKCDDCCGGKGRGACYGPQCLCR

SEQ ID NO: 455 - protein, 36 aa, Artificial Sequence
  Description of Artificial Sequence: Synthetic polypeptide
SCSPCFTTDHQSARACDDCCGGKGRGACYGPQCLCR

SEQ ID NO: 456 - protein, 36 aa, Artificial Sequence
  Description of Artificial Sequence: Synthetic polypeptide
SCSPCFTTDHQSARRCDDCCGGKGRGACYGPQCLCR

SEQ ID NO: 457 - protein, 36 aa, Artificial Sequence
  Description of Artificial Sequence: Synthetic polypeptide
SCSPCFTTDHQSARKCDDCCGGAGRGACYGPQCLCR

SEQ ID NO: 458 - protein, 36 aa, Artificial Sequence
  Description of Artificial Sequence: Synthetic polypeptide
SCSPCFTTDHQSARACDDCCGGAGRGACYGPQCLCR

SEQ ID NO: 459 - protein, 36 aa, Artificial Sequence
  Description of Artificial Sequence: Synthetic polypeptide
SCSPCFTTDHQSARRCDDCCGGAGRGACYGPQCLCR

SEQ ID NO: 460 - protein, 36 aa, Artificial Sequence
  Description of Artificial Sequence: Synthetic polypeptide
SCSPCFTTDHQSARKCDDCCGGRGRGACYGPQCLCR

SEQ ID NO: 461 - protein, 36 aa, Artificial Sequence
  Description of Artificial Sequence: Synthetic polypeptide
SCSPCFTTDHQSARACDDCCGGRGRGACYGPQCLCR

SEQ ID NO: 462 - protein, 36 aa, Artificial Sequence
  Description of Artificial Sequence: Synthetic polypeptide
SCSPCFTTDHQSARRCDDCCGGRGRGACYGPQCLCR

SEQ ID NO: 463 - protein, 36 aa, Artificial Sequence
  Description of Artificial Sequence: Synthetic polypeptide
SCSPCFTTDHQSARKCDDCCGGKGRGRCYGPQCLCR

SEQ ID NO: 464 - protein, 36 aa, Artificial Sequence
  Description of Artificial Sequence: Synthetic polypeptide
SCSPCFTTDHQSARACDDCCGGKGRGRCYGPQCLCR

SEQ ID NO: 465 - protein, 36 aa, Artificial Sequence
  Description of Artificial Sequence: Synthetic polypeptide
SCSPCFTTDHQSARRCDDCCGGKGRGRCYGPQCLCR

SEQ ID NO: 466 - protein, 36 aa, Artificial Sequence
  Description of Artificial Sequence: Synthetic polypeptide
SCSPCFTTDHQSARKCDDCCGGAGRGRCYGPQCLCR

SEQ ID NO: 467 - protein, 36 aa, Artificial Sequence
  Description of Artificial Sequence: Synthetic polypeptide
SCSPCFTTDHQSARACDDCCGGAGRGRCYGPQCLCR

SEQ ID NO: 468 - protein, 36 aa, Artificial Sequence
  Description of Artificial Sequence: Synthetic polypeptide
SCSPCFTTDHQSARRCDDCCGGAGRGRCYGPQCLCR

SEQ ID NO: 469 - protein, 36 aa, Artificial Sequence
  Description of Artificial Sequence: Synthetic polypeptide
SCSPCFTTDHQSARKCDDCCGGRGRGRCYGPQCLCR

SEQ ID NO: 470 - protein, 36 aa, Artificial Sequence
  Description of Artificial Sequence: Synthetic polypeptide
SCSPCFTTDHQSARACDDCCGGRGRGRCYGPQCLCR

SEQ ID NO: 471 - protein, 36 aa, Artificial Sequence
  Description of Artificial Sequence: Synthetic polypeptide
SCSPCFTTDHQSARRCDDCCGGRGRGRCYGPQCLCR

SEQ ID NO: 472 - protein, 36 aa, Artificial Sequence; identical to SEQ ID NO: 471
  Description of Artificial Sequence: Synthetic polypeptide

SEQ ID NO: 473 - protein, 36 aa, Artificial Sequence
  Description of Artificial Sequence: Synthetic polypeptide
KCSPCFTTDHQSARRCDDCCGGRGRGRCYGPQCLCR

SEQ ID NO: 474 - protein, 36 aa, Artificial Sequence; identical to SEQ ID NO: 30
  Description of Artificial Sequence: Synthetic polypeptide

SEQ ID NO: 475 - protein, 36 aa, Artificial Sequence; identical to SEQ ID NO: 31
  Description of Artificial Sequence: Synthetic polypeptide

SEQ ID NO: 476 - protein, 36 aa, Artificial Sequence
  Description of Artificial Sequence: Synthetic polypeptide
  MOD_RES (15)..(15): Citrulline
  MOD_RES (23)..(23): Citrulline
SCSPCFTTDHQSARXCDDCCGGXGRGKCYGPQCLCR

SEQ ID NO: 477 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
SCSPCFTTDHQSARXCDDCCGGXGRGXCYGPQCLCR

SEQ ID NO: 478 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCSPCFTTDHQSARXCDDCCGGXGRGXCYGPQCLCR

SEQ ID NO: 479 - protein, 36 aa, Artificial Sequence; identical to SEQ ID NO: 35
  Description of Artificial Sequence: Synthetic polypeptide
  MOD_RES (15)..(15): Citrulline
  MOD_RES (23)..(23): Citrulline

SEQ ID NO: 480 - protein, 36 aa, Artificial Sequence; identical to SEQ ID NO: 36
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 481 - protein, 36 aa, Artificial Sequence; identical to SEQ ID NO: 37
  Description of Artificial Sequence: Synthetic polypeptide
  MOD_RES (15)..(15): Citrulline
  MOD_RES (23)..(23): Citrulline
  MOD_RES (27)..(27): Citrulline

SEQ ID NO: 482 - protein, 36 aa, Artificial Sequence; identical to SEQ ID NO: 33
  Description of Artificial Sequence: Synthetic polypeptide
  MOD_RES (15)..(15): Any amino acid
  MOD_RES (23)..(23): Any amino acid
  MOD_RES (27)..(27): Any amino acid

SEQ ID NO: 483 - protein, 36 aa, Artificial Sequence; identical to SEQ ID NO: 33
  Description of Artificial Sequence: Synthetic polypeptide
  MOD_RES (15)..(15): Lys, Ala or Arg
  MOD_RES (23)..(23): Lys, Ala or Arg
  MOD_RES (27)..(27): Lys, Ala or Arg

SEQ ID NO: 484 - protein, 36 aa, Artificial Sequence; identical to SEQ ID NO: 32
  Description of Artificial Sequence: Synthetic polypeptide
  MOD_RES (15)..(15): Ala or Arg
  MOD_RES (23)..(23): Ala or Arg

SEQ ID NO: 485 - protein, 42 aa, Artificial Sequence
  Description of Artificial Sequence: Synthetic polypeptide
  MOD_RES (5)..(5): Any amino acid, amino acid analogue or null
  MOD_RES (7)..(8): Any amino acid, amino acid analogue or null
  MOD_RES (11)..(11): Any amino acid, amino acid analogue or null
  MOD_RES (17)..(17): Any amino acid, amino acid analogue or null
  MOD_RES (22)..(24): Any amino acid, amino acid analogue or null
  MOD_RES (26)..(26): Any amino acid, amino acid analogue or null
  MOD_RES (28)..(28): Any amino acid, amino acid analogue or null
  MOD_RES (32)..(32): Any amino acid, amino acid analogue or null
  MOD_RES (39)..(42): Any amino acid, amino acid analogue or null
GSGVXIXXKCXGSKQCXDPCKXXXGXRXGKCXNKKCKCXXXX

SEQ ID NO: 486 - protein, 42 aa, Artificial Sequence
  Description of Artificial Sequence: Synthetic polypeptide
  MOD_RES (5)..(5): P or R
  MOD_RES (7)..(7): P or N
  MOD_RES (8)..(8): V or I
  MOD_RES (11)..(11): S, T, R or K
  MOD_RES (17)..(17): Y or L
  MOD_RES (22)..(22): Q, R or K
  MOD_RES (23)..(23): A, K or R
  MOD_RES (24)..(24): T or A
  MOD_RES (26)..(26): C or M
  MOD_RES (28)..(28): F or N
  MOD_RES (32)..(32): M or I
  MOD_RES (39)..(39): Y or T
  MOD_RES (40)..(40): G or P
  MISC_FEATURE (41)..(42): May or may not be present
GSGVXIXXKCXGSKQCXDPCKXXXGXRXGKCXNKKCKCXXCG

SEQ ID NO: 487 - protein, 41 aa, Artificial Sequence
  Description of Artificial Sequence: Synthetic polypeptide
  MOD_RES (3)..(6): Any amino acid, amino acid analogue or null
  MOD_RES (8)..(8): Any amino acid, amino acid analogue or null
  MOD_RES (10)..(10): Any amino acid, amino acid analogue or null
  MOD_RES (17)..(17): Any amino acid, amino acid analogue or null
  MOD_RES (21)..(22): Any amino acid, amino acid analogue or null
  MOD_RES (26)..(28): Any amino acid, amino acid analogue or null
  MOD_RES (31)..(32): Any amino acid, amino acid analogue or null
  MOD_RES (34)..(34): Any amino acid, amino acid analogue or null
GSXXXXIXCXGSKQCYXPCKXXTGCXXXKCXXKXCKCYGCG

SEQ ID NO: 488 - protein, 41 aa, Artificial Sequence
  Description of Artificial Sequence: Synthetic polypeptide
  MISC_FEATURE (3)..(4): May or may not be present
  MOD_RES (5)..(5): E, G or null
  MOD_RES (6)..(6): V, S or null
  MOD_RES (8)..(8): R or S
  MOD_RES (10)..(10): S or T
  MOD_RES (17)..(17): G or D
  MOD_RES (21)..(21): Q or R
  MOD_RES (22)..(22): Q or K
  MOD_RES (26)..(26): T or P
  MOD_RES (27)..(27): N or Q
  MOD_RES (28)..(28): S or A
  MOD_RES (31)..(31): M or L
  MOD_RES (32)..(32): N or Q
  MOD_RES (34)..(34): V or S
GSGSXXIXCXGSKQCYXPCKXXTGCXXXKCXXKXCKCYGCG

SEQ ID NO: 489 - protein, 42 aa, Artificial Sequence
  Description of Artificial Sequence: Synthetic polypeptide
  MOD_RES (3)..(5): Any amino acid, amino acid analogue or null
  MOD_RES (7)..(7): Any amino acid, amino acid analogue or null
  MOD_RES (9)..(9): Any amino acid, amino acid analogue or null
  MOD_RES (11)..(11): Any amino acid, amino acid analogue or null
  MOD_RES (13)..(14): Any amino acid, amino acid analogue or null
  MOD_RES (16)..(17): Any amino acid, amino acid analogue or null
  MOD_RES (20)..(20): Any amino acid, amino acid analogue or null
  MOD_RES (24)..(24): Any amino acid, amino acid analogue or null
  MOD_RES (33)..(33): Any amino acid, amino acid analogue or null
  MOD_RES (35)..(35): Any amino acid, amino acid analogue or null
  MOD_RES (38)..(38): Any amino acid, amino acid analogue or null
  MOD_RES (42)..(42): Any amino acid, amino acid analogue or null
GSXXXVXIXVXCXXSXXCLXPCKXAGMRFGKCXNXKCXCTPX

SEQ ID NO: 490 - protein, 42 aa, Artificial Sequence
  Description of Artificial Sequence: Synthetic polypeptide
  MISC_FEATURE (3)..(3): May or may not be present
  MOD_RES (4)..(4): G, S or null
  MOD_RES (5)..(5): G, S or null
  MOD_RES (7)..(7): P or R
  MOD_RES (9)..(9): N or P
  MOD_RES (11)..(11): K or S
  MOD_RES (13)..(13): R or K
  MOD_RES (14)..(14): G or H
  MOD_RES (16)..(16): R or G
  MOD_RES (17)..(17): D or Q
  MOD_RES (20)..(20): D or K
  MOD_RES (24)..(24): K or D
  MOD_RES (33)..(33): I or M
  MOD_RES (35)..(35): S or G
  MOD_RES (38)..(38): H or D
  MISC_FEATURE (42)..(42): May or may not be present
GSGXXVXIXVXCXXSXXCLXPCKXAGMRFGKCXNXKCXCTPK

SEQ ID NO: 491 - protein, 37 aa, Artificial Sequence
  Description of Artificial Sequence: Synthetic polypeptide
  MOD_RES (3)..(3): Any amino acid
  MOD_RES (5)..(5): Any amino acid
  MOD_RES (9)..(9): Any amino acid
  MOD_RES (15)..(15): Any amino acid
  MOD_RES (20)..(20): Any amino acid
  MOD_RES (22)..(22): Any amino acid
  MOD_RES (24)..(24): Any amino acid
  MOD_RES (32)..(32): Any amino acid
  MOD_RES (37)..(37): Any amino acid
  See specification as filed for detailed description of substitutions and preferred embodiments
GSXVXVKCXGSKQCXPCKRXGXRXGKCINKKXCKCYX

SEQ ID NO: 492 - protein, 34 aa, Artificial Sequence
  Description of Artificial Sequence: Synthetic polypeptide
  MOD_RES (3)..(3): Any amino acid
  MOD_RES (7)..(7): Any amino acid
  MOD_RES (13)..(13): Any amino acid
  MOD_RES (15)..(15): Any amino acid
  MOD_RES (18)..(18): Any amino acid
  MOD_RES (20)..(20): Any amino acid
  MOD_RES (29)..(29): Any amino acid
  MOD_RES (34)..(34): Any amino acid
  See specification as filed for detailed description of substitutions and preferred embodiments
GSXGCVXKCRPGXKXCCXPXKRCSRRFGXKKCKX

SEQ ID NO: 493 - protein, 43 aa, Artificial Sequence
  Description of Artificial Sequence: Synthetic polypeptide
  MOD_RES (3)..(3): Any amino acid, amino acid analogue or null
  MOD_RES (5)..(7): Any amino acid, amino acid analogue or null
  MOD_RES (11)..(11): Any amino acid, amino acid analogue or null
  MOD_RES (17)..(18): Any amino acid, amino acid analogue or null
  MOD_RES (23)..(24): Any amino acid, amino acid analogue or null
  MOD_RES (26)..(26): Any amino acid, amino acid analogue or null
  MOD_RES (28)..(28): Any amino acid, amino acid analogue or null
  MOD_RES (36)..(36): Any amino acid, amino acid analogue or null
  MOD_RES (41)..(43): Any amino acid, amino acid analogue or null
GSXVXXXVKCXGSKQCXXPCKRXXGXRXGKCINKKXCKCYXXX

SEQ ID NO: 494 - protein, 47 aa, Artificial Sequence
  Description of Artificial Sequence: Synthetic polypeptide
  MOD_RES (3)..(5): Any amino acid
  MOD_RES (9)..(12): Any amino acid
  MOD_RES (18)..(18): Any amino acid
  MOD_RES (20)..(20): Any amino acid
  MOD_RES (23)..(23): Any amino acid
  MOD_RES (25)..(25): Any amino acid
  MOD_RES (34)..(37): Any amino acid
  MOD_RES (42)..(47): Any amino acid
GSXXXGCVXXXXKCRPGXKXCCXPXKRCSRRFGXXXXKKCKXXXXXX

SEQ ID NO: 495 - protein, 42 aa, Artificial Sequence
  Description of Artificial Sequence: Synthetic polypeptide
  MOD_RES (5)..(5): Any amino acid, amino acid analogue or null
  MOD_RES (7)..(8): Any amino acid, amino acid analogue or null
  MOD_RES (11)..(11): Any amino acid, amino acid analogue or null
  MOD_RES (17)..(17): Any amino acid, amino acid analogue or null
  MOD_RES (22)..(24): Any amino acid, amino acid analogue or null
  MOD_RES (26)..(26): Any amino acid, amino acid analogue or null
  MOD_RES (28)..(28): Any amino acid, amino acid analogue or null
  MOD_RES (32)..(32): Any amino acid, amino acid analogue or null
  MOD_RES (39)..(42): Any amino acid, amino acid analogue or null
GSGVXIXXRCXGSRQCXDPCRXXXGXRXGRCXNRRCRCXXXX

SEQ ID NO: 496 - protein, 42 aa, Artificial Sequence
  Description of Artificial Sequence: Synthetic polypeptide
  MOD_RES (5)..(5): P or R
  MOD_RES (7)..(7): P or N
  MOD_RES (8)..(8): V or I
  MOD_RES (11)..(11): S, T, R or K
  MOD_RES (17)..(17): Y or L
  MOD_RES (22)..(22): Q, R or K
  MOD_RES (23)..(23): A, K or R
  MOD_RES (24)..(24): T or A
  MOD_RES (26)..(26): C or M
  MOD_RES (28)..(28): F or N
  MOD_RES (32)..(32): M or I
  MOD_RES (39)..(39): Y or T
  MOD_RES (40)..(40): G or P
  MISC_FEATURE (41)..(42): May or may not be present
GSGVXIXXRCXGSRQCXDPCRXXXGXRXGRCXNRRCRCXXCG

SEQ ID NO: 497 - protein, 41 aa, Artificial Sequence
  Description of Artificial Sequence: Synthetic polypeptide
  MOD_RES (3)..(6): Any amino acid, amino acid analogue or null
  MOD_RES (8)..(8): Any amino acid, amino acid analogue or null
  MOD_RES (10)..(10): Any amino acid, amino acid analogue or null
  MOD_RES (17)..(17): Any amino acid, amino acid analogue or null
  MOD_RES (21)..(22): Any amino acid, amino acid analogue or null
  MOD_RES (26)..(28): Any amino acid, amino acid analogue or null
  MOD_RES (31)..(32): Any amino acid, amino acid analogue or null
  MOD_RES (34)..(34): Any amino acid, amino acid analogue or null
GSXXXXIXCXGSRQCYXPCRXXTGCXXXRCXXRXCRCYGCG

SEQ ID NO: 498 - protein, 41 aa, Artificial Sequence
  Description of Artificial Sequence: Synthetic polypeptide
  MISC_FEATURE (3)..(4): May or may not be present
  MOD_RES (5)..(5): E, G or null
  MOD_RES (6)..(6): V, S or null
  MOD_RES (8)..(8): R or S
  MOD_RES (10)..(10): S or T
  MOD_RES (17)..(17): G or D
  MOD_RES (21)..(21): Q or R
  MOD_RES (22)..(22): Q, R or K
  MOD_RES (26)..(26): T or P
  MOD_RES (27)..(27): N or Q
  MOD_RES (28)..(28): S or A
  MOD_RES (31)..(31): M or L
  MOD_RES (32)..(32): N or Q
  MOD_RES (34)..(34): V or S
GSGSXXIXCXGSRQCYXPCRXXTGCXXXRCXXRXCRCYGCG

SEQ ID NO: 499 - protein, 42 aa, Artificial Sequence
  Description of Artificial Sequence: Synthetic polypeptide
  MOD_RES (3)..(5): Any amino acid, amino acid analogue or null
  MOD_RES (7)..(7): Any amino acid, amino acid analogue or null
  MOD_RES (9)..(9): Any amino acid, amino acid analogue or null
  MOD_RES (11)..(11): Any amino acid, amino acid analogue or null
  MOD_RES (13)..(14): Any amino acid, amino acid analogue or null
  MOD_RES (16)..(17): Any amino acid, amino acid analogue or null
  MOD_RES (20)..(20): Any amino acid, amino acid analogue or null
  MOD_RES (24)..(24): Any amino acid, amino acid analogue or null
  MOD_RES (33)..(33): Any amino acid, amino acid analogue or null
  MOD_RES (35)..(35): Any amino acid, amino acid analogue or null
  MOD_RES (38)..(38): Any amino acid, amino acid analogue or null
  MOD_RES (42)..(42): Any amino acid, amino acid analogue or null
GSXXXVXIXVXCXXSXXCLXPCRXAGMRFGRCXNXRCXCTPX

SEQ ID NO: 500 - protein, 42 aa, Artificial Sequence
  Description of Artificial Sequence: Synthetic polypeptide
  MISC_FEATURE (3)..(3): May or may not be present
  MOD_RES (4)..(4): G, S or null
  MOD_RES (5)..(5): G, S or null
  MOD_RES (7)..(7): P or R
  MOD_RES (9)..(9): N or P
  MOD_RES (11)..(11): R, K or S
  MOD_RES (13)..(13): R or K
  MOD_RES (14)..(14): G or H
  MOD_RES (16)..(16): R or G
  MOD_RES (17)..(17): D or Q
  MOD_RES (20)..(20): D, R or K
  MOD_RES (24)..(24): K, R or D
  MOD_RES (33)..(33): I or M
  MOD_RES (35)..(35): S or G
  MOD_RES (38)..(38): H or D
  MOD_RES (42)..(42): K, R or null
GSGXXVXIXVXCXXSXXCLXPCRXAGMRFGRCXNXRCXCTPX

SEQ ID NO: 501 - protein, 37 aa, Artificial Sequence
  Description of Artificial Sequence: Synthetic polypeptide
  MOD_RES (3)..(3): Any amino acid
  MOD_RES (5)..(5): Any amino acid
  MOD_RES (9)..(9): Any amino acid
  MOD_RES (15)..(15): Any amino acid
  MOD_RES (20)..(20): Any amino acid
  MOD_RES (22)..(22): Any amino acid
  MOD_RES (24)..(24): Any amino acid
  MOD_RES (32)..(32): Any amino acid
  MOD_RES (37)..(37): Any amino acid
  See specification as filed for detailed description of substitutions and preferred embodiments
GSXVXVRCXGSRQCXPCRRXGXRXGRCINRRXCRCYX

SEQ ID NO: 502 - protein, 34 aa, Artificial Sequence
  Description of Artificial Sequence: Synthetic polypeptide
  MOD_RES (3)..(3): Any amino acid
  MOD_RES (7)..(7): Any amino acid
  MOD_RES (13)..(13): Any amino acid
  MOD_RES (15)..(15): Any amino acid
  MOD_RES (18)..(18): Any amino acid
  MOD_RES (20)..(20): Any amino acid
  MOD_RES (29)..(29): Any amino acid
  MOD_RES (34)..(34): Any amino acid
  See specification as filed for detailed description of substitutions and preferred embodiments
GSXGCVXRCRPGXRXCCXPXRRCSRRFGXRRCRX

SEQ ID NO: 503 - protein, 43 aa, Artificial Sequence
  Description of Artificial Sequence: Synthetic polypeptide
  MOD_RES (3)..(3): Any amino acid analogue or null
  MOD_RES (5)..(7): Any amino acid analogue or null
  MOD_RES (11)..(11): Any amino acid analogue or null
  MOD_RES (17)..(18): Any amino acid analogue or null
  MOD_RES (23)..(24): Any amino acid analogue or null
  MOD_RES (26)..(26): Any amino acid analogue or null
  MOD_RES (28)..(28): Any amino acid analogue or null
  MOD_RES (36)..(36): Any amino acid analogue or null
  MOD_RES (41)..(43): Any amino acid analogue or null
GSXVXXXVRCXGSRQCXXPCRRXXGXRXGRCINRRXCRCYXXX

SEQ ID NO: 504 - protein, 47 aa, Artificial Sequence
  Description of Artificial Sequence: Synthetic polypeptide
  MOD_RES (3)..(5): Any amino acid analogue or null
  MOD_RES (9)..(12): Any amino acid analogue or null
  MOD_RES (18)..(18): Any amino acid analogue or null
  MOD_RES (20)..(20): Any amino acid analogue or null
  MOD_RES (23)..(23): Any amino acid analogue or null
  MOD_RES (25)..(25): Any amino acid analogue or null
  MOD_RES (34)..(37): Any amino acid analogue or null
  MOD_RES (42)..(47): Any amino acid analogue or null
GSXXXGCVXXXXRCRPGXRXCCXPXRRCSRRFGXXXXRRCRXXXXXX

SEQ ID NO: 505 - protein, 42 aa, Artificial Sequence
  Description of Artificial Sequence: Synthetic polypeptide
  MOD_RES (3)..(3): Any amino acid, amino acid analogue or null
  MOD_RES (5)..(5): Any amino acid, amino acid analogue or null
  MOD_RES (7)..(7): Any amino acid, amino acid analogue or null
  MOD_RES (11)..(11): Any amino acid, amino acid analogue or null
  MOD_RES (14)..(14): Any amino acid, amino acid analogue or null
  MOD_RES (18)..(18): Any amino acid, amino acid analogue or null
  MOD_RES (22)..(22): Any amino acid, amino acid analogue or null
  MOD_RES (24)..(24): Any amino acid, amino acid analogue or null
  MOD_RES (26)..(26): Any amino acid, amino acid analogue or null
  MOD_RES (28)..(28): Any amino acid, amino acid analogue or null
  MOD_RES (37)..(37): Any amino acid, amino acid analogue or null
  MOD_RES (39)..(39): Any amino acid, amino acid analogue or null
  MOD_RES (41)..(42): Any amino acid, amino acid analogue or null
GSXVXIXVKCXGSXQCLXPCKXAXGXRXGKCMNGKCXCXPXX

SEQ ID NO: 506 - protein, 42 aa, Artificial Sequence
  Description of Artificial Sequence: Synthetic polypeptide
  MOD_RES (3)..(3): Any amino acid, amino acid analogue or null
  MOD_RES (5)..(5): Any amino acid, amino acid analogue or null
  MOD_RES (7)..(7): Any amino acid, amino acid analogue or null
  MOD_RES (11)..(11): Any amino acid, amino acid analogue or null
  MOD_RES (14)..(14): Any amino acid, amino acid analogue or null
  MOD_RES (18)..(18): Any amino acid, amino acid analogue or null
  MOD_RES (22)..(22): Any amino acid, amino acid analogue or null
  MOD_RES (24)..(24): Any amino acid, amino acid analogue or null
  MOD_RES (26)..(26): Any amino acid, amino acid analogue or null
  MOD_RES (28)..(28): Any amino acid, amino acid analogue or null
  MOD_RES (37)..(37): Any amino acid, amino acid analogue or null
  MOD_RES (39)..(39): Any amino acid, amino acid analogue or null
  MOD_RES (41)..(42): Any amino acid, amino acid analogue or null
GSXVXIXVRCXGSXQCLXPCRXAXGXRXGRCMNGRCXCXPXX

SEQ ID NO: 507 - protein, 39 aa, Artificial Sequence
  Description of Artificial Sequence: Synthetic polypeptide
  MOD_RES (7)..(7): N, S or G
  MOD_RES (17)..(17): L or Y
  MOD_RES (18)..(18): D or E
  MOD_RES (25)..(25): M or T
  MOD_RES (32)..(32): N, Q, A, S, T or L
  MOD_RES (33)..(33): S, G or R
  MOD_RES (36)..(36): H or Y
  MOD_RES (38)..(38): T or Y
GSGVPIXVRCRGSRDCXXPCRRAGXRFGRCIXXRCXCXP

SEQ ID NO: 508 - protein, 34 aa, Artificial Sequence
  Description of Artificial Sequence: Synthetic polypeptide
  See specification as filed for detailed description of substitutions and preferred embodiments
GSGIVCKVCKIICGMQGKKVNICKAPIKCKCKKG

SEQ ID NO: 509 - protein, 37 aa, Artificial Sequence
  Description of Artificial Sequence: Synthetic polypeptide
  See specification as filed for detailed description of substitutions and preferred embodiments
GSSEKDCIKHLQRCRENKDCCSKKCSRRGTNPEKRCR

SEQ ID NO: 510 - protein, 39 aa, Artificial Sequence
  Description of Artificial Sequence: Synthetic polypeptide
  See specification as filed for detailed description of substitutions and preferred embodiments
GSVRIPVSCKHSGQCLKPCKDAGMRFGKCMNGKCDCTPK

SEQ ID NO: 511 - protein, 39 aa, Artificial Sequence
  Description of Artificial Sequence: Synthetic polypeptide
  See specification as filed for detailed description of substitutions and preferred embodiments
GSGVPINVKCRGSRDCLDPCKKAGMRFGKCINSKCHCTP

SEQ ID NO: 512 - protein, 35 aa, Artificial Sequence
  Description of Artificial Sequence: Synthetic polypeptide
  See specification as filed for detailed description of substitutions and preferred embodiments
GSAVCVYRTCDKDCKRRGYRSGKCINNACKCYPYG

SEQ ID NO: 513 - protein, 37 aa, Artificial Sequence
  Description of Artificial Sequence: Synthetic polypeptide
  See specification as filed for detailed description of substitutions and preferred embodiments
GSISCTGSKQCYDPCKRKTGCPNAKCMNKSCKCYGCG

SEQ ID NO: 514 - protein, 40 aa, Artificial Sequence
  Description of Artificial Sequence: Synthetic polypeptide
  See specification as filed for detailed description of substitutions and preferred embodiments
GSQVQTNVKCQGGSCASVCRREIGVAAGKCINGKCVCYRN

SEQ ID NO: 515 - protein, 39 aa, Artificial Sequence
  Description of Artificial Sequence: Synthetic polypeptide
  See specification as filed for detailed description of substitutions and preferred embodiments
GSEVIRCSGSKQCYGPCKQQTGCTNSKCMNKVCKCYGCG

SEQ ID NO: 516 - protein, 35 aa, Artificial Sequence
  Description of Artificial Sequence: Synthetic polypeptide
  See specification as filed for detailed description of substitutions and preferred embodiments
GSACKGVFDACTPGKNECCPNRVCSDKHKWCKWKL

SEQ ID NO: 517 - protein, 40 aa, Artificial Sequence
  Description of Artificial Sequence: Synthetic polypeptide
  See specification as filed for detailed description of substitutions and preferred embodiments
GSQIYTSKECNGSSECYSHCEGITGKRSGKCINKKCYCYR

SEQ ID NO: 518 - protein, 37 aa, Artificial Sequence
  Description of Artificial Sequence: Synthetic polypeptide
  See specification as filed for detailed description of substitutions and preferred embodiments
GSGCLEFWWKCNPNDDKCCRPKLKCSKLFKLCNFSFG

SEQ ID NO: 519 - protein, 39 aa, Artificial Sequence
  Description of Artificial Sequence: Synthetic polypeptide
GSDCVRFWGKCSQTSDCCPHLACKSKWPRNICVWDGSVG

SEQ ID NO: 520 - protein, 35 aa, Artificial Sequence
  Description of Artificial Sequence: Synthetic polypeptide
  See specification as filed for detailed description of substitutions and preferred embodiments
GSGCFGYKCDYYKGCCSGYVCSPTWKWCVRPGPGR

SEQ ID NO: 521 - protein, 62 aa, Artificial Sequence
  Description of Artificial Sequence: Synthetic polypeptide
GSMNAKFILLLVLTTMMLLPDTKGAEVIRCSGSKQCYGPCKQQTGCTNSKCMNKVCKCYGCG

SEQ ID NO: 522 - protein, 63 aa, Artificial Sequence
  Description of Artificial Sequence: Synthetic polypeptide
GSMNAKLIYLLLVVTTMTLMFDTAQAVDIMCSGPKQCYGPCKKETGCPNAKCMNRRCKCYGCV

SEQ ID NO: 523 - protein, 64 aa, Artificial Sequence
  Description of Artificial Sequence: Synthetic polypeptide
GSMNAKLIYLLLVVTTMMLTFDTTQAGDIKCSGTRQCWGPCKKQTTCTNSKCMNGKCKCYGCVG

SEQ ID NO: 524 - protein, 63 aa, Artificial Sequence
  Description of Artificial Sequence: Synthetic polypeptide
GSMNTKFIFLLLVVTNTMMLFDTKPVEGISCTGSKQCYDPCKRKTGCPNAKCMNKSCKCYGCG

SEQ ID NO: 525 - protein, 40 aa, Artificial Sequence
  Description of Artificial Sequence: Synthetic polypeptide
GSGVPINVKCSGSRDCLEPCKKAGMRFGKCINRKCHCTPK

SEQ ID NO: 526 - protein, 40 aa, Artificial Sequence
  Description of Artificial Sequence: Synthetic polypeptide
GSGVPINVKCTGSPQCLKPCKDAGMRFGKCINGKCHCTPK

SEQ ID NO: 527 - protein, 40 aa, Artificial Sequence
  Description of Artificial Sequence: Synthetic polypeptide
GSGVIINVKCKISRQCLEPCKKAGMRFGKCMNGKCHCTPK

SEQ ID NO: 528 - protein, 40 aa, Artificial Sequence
  Description of Artificial Sequence: Synthetic polypeptide
GSGVPINVKCRGSPQCIQPCRDAGMRFGKCMNGKCHCTPQ

SEQ ID NO: 529 - protein, 40 aa, Artificial Sequence
  Description of Artificial Sequence: Synthetic polypeptide
GSGVEINVKCTGSHQCIKPCKDAGMRFGKCINRKCHCTPK

SEQ ID NO: 530 - protein, 40 aa, Artificial Sequence
  Description of Artificial Sequence: Synthetic polypeptide
GSGVEINVKCSGSPQCLKPCKDAGMRFGKCMNRKCHCTPK

SEQ ID NO: 531 - protein, 40 aa, Artificial Sequence
  Description of Artificial Sequence: Synthetic polypeptide
GSGVPTDVKCRGSPQCIQPCKDAGMRFGKCMNGKCHCTPK

SEQ ID NO: 532 - protein, 40 aa, Artificial Sequence
  Description of Artificial Sequence: Synthetic polypeptide
GSGVPINVSCTGSPQCIKPCKDAGMRFGKCMNRKCHCTPK

SEQ ID NO: 533 - protein, 40 aa, Artificial Sequence
  Description of Artificial Sequence: Synthetic polypeptide
GSGVPINVPCTGSPQCIKPCKDAGMRFGKCMNRKCHCTPK

SEQ ID NO: 534 - protein, 39 aa, Artificial Sequence
  Description of Artificial Sequence: Synthetic polypeptide
GSVGINVKCKHSGQCLKPCKDAGMRFGKCINGKCDCTPK

SEQ ID NO: 535 - protein, 39 aa, Artificial Sequence
  Description of Artificial Sequence: Synthetic polypeptide
GSVGINVKCKHSGQCLKPCKDAGMRFGKCMNGKCDCTPK

SEQ ID NO: 536 - protein, 39 aa, Artificial Sequence
  Description of Artificial Sequence: Synthetic polypeptide
GSVGIPVSCKHSGQCIKPCKDAGMRFGKCMNRKCDCTPK

SEQ ID NO: 537 - protein, 38 aa, Artificial Sequence
  Description of Artificial Sequence: Synthetic polypeptide
GSRKGCFKEGHSCPKTAPCCRPLVCKGPSPNTKKCTRP

SEQ ID NO: 538 - protein, 34 aa, Artificial Sequence
  Description of Artificial Sequence: Synthetic polypeptide
GSSFCIPFKPCKSDENCCKKFKCKTTGIVKLCRW

SEQ ID NO: 539 - protein, 38 aa, Artificial Sequence
  Description of Artificial Sequence: Synthetic polypeptide
GSLKGCLPRNRFCNALSGPRCCSGLRCKELSIWASKCL

SEQ ID NO: 540 - protein, 36 aa, Artificial Sequence
  Description of Artificial Sequence: Synthetic polypeptide
GSGNYCLRGRCLPGGRKCCNGRPCECFAKICSCKPK

SEQ ID NO: 541 - protein, 31 aa, Artificial Sequence
  Description of Artificial Sequence: Synthetic polypeptide
GSTVKCGGCNRKCCPGGCRSGKCINGKCQCY

SEQ ID NO: 542 - protein, 31 aa, Artificial Sequence
  Description of Artificial Sequence: Synthetic polypeptide
GSGCMKEYCAGQCRGKVSQDYCLKHCKCIPR

SEQ ID NO: 543 - protein, 36 aa, Artificial Sequence
  Description of Artificial Sequence: Synthetic polypeptide
GSACLGFGEKCNPSNDKCCKSSSLVCSQKHKWCKYG

SEQ ID NO: 544 - protein, 39 aa, Artificial Sequence
  Description of Artificial Sequence: Synthetic polypeptide
GSRGGCLPHNRFCNALSGPRCCSGLRCKELSIRDSRCLG

SEQ ID NO: 545 - protein, 38 aa, Artificial Sequence
  Description of Artificial Sequence: Synthetic polypeptide
GSRGGCLPRNKFCNPSSGPRCCSGLTCKELNIWASKCL

SEQ ID NO: 546 - protein, 35 aa, Artificial Sequence
  Description of Artificial Sequence: Synthetic polypeptide
GSQRSCAKPGDMCMGIKCCDGQCGCNRGTGRCFCK

SEQ ID NO: 547 - protein, 42 aa, Artificial Sequence
  Description of Artificial Sequence: Synthetic polypeptide
GSARGCADAYKSCNHPRTCCDGYNGYKRACICSGSNCKCKKS

SEQ ID NO: 548 - protein, 39 aa, Artificial Sequence
  Description of Artificial Sequence: Synthetic polypeptide
GSRGGCLPHNRFCNALSGPRCCSGLRCKELSIWDSRCLG

SEQ ID NO: 549 - protein, 39 aa, Artificial Sequence
  Description of Artificial Sequence: Synthetic polypeptide
GSRGGCLPHNRFCNALSGPRCCSGLKCKELSIYDSRCLG

SEQ ID NO: 550 - protein, 39 aa, Artificial Sequence
  Description of Artificial Sequence: Synthetic polypeptide
GSRGGCLPHNRFCNALSGPRCCSRLKCKELSIWDSRCLG

SEQ ID NO: 551 - protein, 39 aa, Artificial Sequence
  Description of Artificial Sequence: Synthetic polypeptide
GSRGGCLPHNRFCNALTGPRCCSRLRCKELSIWDSICLG

SEQ ID NO: 552 - protein, 36 aa, Artificial Sequence
  Description of Artificial Sequence: Synthetic polypeptide
GSSCADAYKSCDSLKCCNNRTCMCSMIGTNCTCRKK

SEQ ID NO: 553 - protein, 32 aa, Artificial Sequence
  Description of Artificial Sequence: Synthetic polypeptide
GSERRCLPAGKTCVRGPMRVPCCGSCSQNKCT

SEQ ID NO: 554 - protein, 33 aa, Artificial Sequence
  Description of Artificial Sequence: Synthetic polypeptide
GSLCSREGEFCYKLRKCCAGFYCKAFVLHCYRN

SEQ ID NO: 555 - protein, 25 aa, Artificial Sequence
  Description of Artificial Sequence: Synthetic peptide
GSACGSCRKKCKGSGKCINGRCKCY

SEQ ID NO: 556 - protein, 25 aa, Artificial Sequence
  Description of Artificial Sequence: Synthetic peptide
GSACGSCRKKCKGPGKCINGRCKCY

SEQ ID NO: 557 - protein, 34 aa, Artificial Sequence
  Description of Artificial Sequence: Synthetic polypeptide
GSACQGYMRKCGRDKPPCCKKLECSKTWRWCVWN

SEQ ID NO: 558 - protein, 32 aa, Artificial Sequence
  Description of Artificial Sequence: Synthetic polypeptide
GSGRYCQKWMWTCDSKRACCEGLRCKLWCRKI

SEQ ID NO: 559 - protein, 36 aa, Artificial Sequence
  Description of Artificial Sequence: Synthetic polypeptide
GSNAKCRGSPECLPKCKEAIGKAAGKCMNGKCKCYP

SEQ ID NO: 560 - protein, 36 aa, Artificial Sequence
  Description of Artificial Sequence: Synthetic polypeptide
GSNVKCRGSKECLPACKAAVGKAAGKCMNGKCKCYP

SEQ ID NO: 561 - protein, 36 aa, Artificial Sequence
  Description of Artificial Sequence: Synthetic polypeptide
GSNVKCRGSPECLPKCKEAIGKSAGKCMNGKCKCYP

SEQ ID NO: 562 - protein, 36 aa, Artificial Sequence
  Description of Artificial Sequence: Synthetic polypeptide
GSNAKCRGSPECLPKCKQAIGKAAGKCMNGKCKCYP

SEQ ID NO: 563 - protein, 35 aa, Artificial Sequence
  Description of Artificial Sequence: Synthetic polypeptide
GSRGYCAEKGIKCHNIHCCSGLTCKCKGSSCVCRK

SEQ ID NO: 564 - protein, 33 aa, Artificial Sequence
  Description of Artificial Sequence: Synthetic polypeptide
GSERGCKLTFWKCKNKKECCGWNACALGICMPR

SEQ ID NO: 565 - protein, 41 aa, Artificial Sequence
  Description of Artificial Sequence: Synthetic polypeptide
GSKKKCIAKDYGRCKWGGTPCCRGRGCICSIMGTNCECKPR

SEQ ID NO: 566 - protein, 31 aa, Artificial Sequence
  Description of Artificial Sequence: Synthetic polypeptide
GSGCKLTFWKCKNKKECCGWNACALGICMPR

SEQ ID NO: 567 - protein, 34 aa, Artificial Sequence
  Description of Artificial Sequence: Synthetic polypeptide
GSACKGLFVTCTPGKDECCPNHVCSSKHKWCKYK

SEQ ID NO: 568 - protein, 38 aa, Artificial Sequence
  Description of Artificial Sequence: Synthetic polypeptide
GSIACAPRGLLCFRDKECCKGLTCKGRFVNTWPTFCLV

SEQ ID NO: 569 - protein, 38 aa, Artificial Sequence
  Description of Artificial Sequence: Synthetic polypeptide
GSACAGLYKKCGKGVNTCCENRPCKCDLAMGNCICKKK

SEQ ID NO: 570 - protein, 40 aa, Artificial Sequence
  Description of Artificial Sequence: Synthetic polypeptide
GSFTCAISCDIKVNGKPCKGSGEKKCSGGWSCKFNVCVKV

SEQ ID NO: 571 - protein, 35 aa, Artificial Sequence
  Description of Artificial Sequence: Synthetic polypeptide
GSGFCAQKGIKCHDIHCCTNLKCVREGSNRVCRKA

SEQ ID NO: 572 - protein, 44 aa, Artificial Sequence
  Description of Artificial Sequence: Synthetic polypeptide
GSCAKKRNWCGKNEDCCCPMKCIYAWYNQQGSCQSTITGLFKKC

SEQ ID NO: 573 - protein, 30 aa, Artificial Sequence
  Description of Artificial Sequence: Synthetic polypeptide
GSYCQKWMWTCDSARKCCEGLVCRLWCKKI

SEQ ID NO: 574 - protein, 39 aa, Artificial Sequence
  Description of Artificial Sequence: Synthetic polypeptide
GSRGGCLPHNKFCNALSGPRCCSGLKCKELTIWNTKCLE

SEQ ID NO: 575 - protein, 36 aa, Artificial Sequence
  Description of Artificial Sequence: Synthetic polypeptide
GSNVKCTGSKQCLPACKAAVGKAAGKCMNGKCKCYT

SEQ ID NO: 576 - protein, 35 aa, Artificial Sequence
  Description of Artificial Sequence: Synthetic polypeptide
GSQRSCAKPGEMCMRIKCCDGQCGCNRGTGRCFCK

SEQ ID NO: 577 - protein, 38 aa, Artificial Sequence
  Description of Artificial Sequence: Synthetic polypeptide
GSGCIPKHKRCTWSGPKCCNNISCHCNISGTLCKCRPG

SEQ ID NO: 578 - protein, 35 aa, Artificial Sequence
  Description of Artificial Sequence: Synthetic polypeptide
GSNYCVAKRCRPGGRQCCSGKPCACVGKVCKCPRD

SEQ ID NO: 579 - protein, 39 aa, Artificial Sequence
  Description of Artificial Sequence: Synthetic polypeptide
GSERGCSGAYKRCSSSQRCCEGRPCVCSAINSNCKCRKT

SEQ ID NO: 580 - protein, 38 aa, Artificial Sequence
  Description of Artificial Sequence: Synthetic polypeptide
GSRYCPRNPEACYNYCLRTGRPGGYCGGRSRITCFCFR

SEQ ID NO: 581 - protein, 35 aa, Artificial Sequence
  Description of Artificial Sequence: Synthetic polypeptide
GSQRSCAKPGEMCMGIKCCDGQCGCNRGTGRCFCK

SEQ ID NO: 582 - protein, 38 aa, Artificial Sequence
  Description of Artificial Sequence: Synthetic polypeptide
GSRRGCFKEGKWCPKSAPCCAPLKCKGPSIKQQKCVRE

SEQ ID NO: 583 - protein, 33 aa, Artificial Sequence
  Description of Artificial Sequence: Synthetic polypeptide
GSTVKCGGCNRKCCAGGCRSGKCINGKCQCYGR

SEQ ID NO: 584 - protein, 31 aa, Artificial Sequence
  Description of Artificial Sequence: Synthetic polypeptide
GSERRCEPSGKPCRPLMRIPCCGSCVRGKCA

SEQ ID NO: 585 - protein, 38 aa, Artificial Sequence
  Description of Artificial Sequence: Synthetic polypeptide
GSRGGCLPRNKFCNPSSGPRCCSGLTCKELNIWANKCL

SEQ ID NO: 586 - protein, 44 aa, Artificial Sequence
  Description of Artificial Sequence: Synthetic polypeptide
GSCAKKRNWCGKNEDCCCPMKCIYAWYNQQGSCQTTITGLFKKC

SEQ ID NO: 587 - protein, 39 aa, Artificial Sequence
  Description of Artificial Sequence: Synthetic polypeptide
GSVRIPVSCKHSGQCLKPCKDAGMRTGKCMNGKCDCTPK

SEQ ID NO: 588 - protein, 22 aa, Artificial Sequence
  Description of Artificial Sequence: Synthetic peptide
GSVKCTTSKDCWPPCKKVTGRA

SEQ ID NO: 589 - protein, 34 aa, Artificial Sequence
  Description of Artificial Sequence: Synthetic polypeptide
GSGIVCRVCRIICGMQGRRVNICRAPIRCRCRRG

SEQ ID NO: 590 - protein, 37 aa, Artificial Sequence
  Description of Artificial Sequence: Synthetic polypeptide
GSSERDCIRHLQRCRENRDCCSRRCSRRGTNPERRCR

SEQ ID NO: 591 - protein, 39 aa, Artificial Sequence
  Description of Artificial Sequence: Synthetic polypeptide
GSVRIPVSCRHSGQCLRPCRDAGMRFGRCMNGRCDCTPR

SEQ ID NO: 592 - protein, 39 aa, Artificial Sequence
  Description of Artificial Sequence: Synthetic polypeptide
GSGVPINVRCRGSRDCLDPCRRAGMRFGRCINSRCHCTP

SEQ ID NO: 593 - protein, 35 aa, Artificial Sequence
  Description of Artificial Sequence: Synthetic polypeptide
GSAVCVYRTCDRDCRRRGYRSGRCINNACRCYPYG

SEQ ID NO: 594 - protein, 37 aa, Artificial Sequence
  Description of Artificial Sequence: Synthetic polypeptide
GSISCTGSRQCYDPCRRRTGCPNARCMNRSCRCYGCG

SEQ ID NO: 595 - protein, 40 aa, Artificial Sequence
  Description of Artificial Sequence: Synthetic polypeptide
GSQVQTNVRCQGGSCASVCRREIGVAAGRCINGRCVCYRN

SEQ ID NO: 596 - protein, 39 aa, Artificial Sequence
  Description of Artificial Sequence: Synthetic polypeptide
GSEVIRCSGSRQCYGPCRQQTGCTNSRCMNRVCRCYGCG

SEQ ID NO: 597 - protein, 35 aa, Artificial Sequence
  Description of Artificial Sequence: Synthetic polypeptide
GSACRGVFDACTPGRNECCPNRVCSDRHRWCRWRL

SEQ ID NO: 598 - protein, 40 aa, Artificial Sequence
  Description of Artificial Sequence: Synthetic polypeptide
GSQIYTSRECNGSSECYSHCEGITGRRSGRCINRRCYCYR

SEQ ID NO: 599 - protein, 37 aa, Artificial Sequence
  Description of Artificial Sequence: Synthetic polypeptide
GSGCLEFWWRCNPNDDRCCRPRLRCSRLFRLCNFSFG

SEQ ID NO: 600 - protein, 39 aa, Artificial Sequence
  Description of Artificial Sequence: Synthetic polypeptide
GSDCVRFWGRCSQTSDCCPHLACRSRWPRNICVWDGSVG

SEQ ID NO: 601 - protein, 35 aa, Artificial Sequence
  Description of Artificial Sequence: Synthetic polypeptide
GSGCFGYRCDYYRGCCSGYVCSPTWRWCVRPGPGR

SEQ ID NO: 602 - protein, 62 aa, Artificial Sequence
  Description of Artificial Sequence: Synthetic polypeptide
GSMNARFILLLVLTTMMLLPDTRGAEVIRCSGSRQCYGPCRQQTGCTNSRCMNRVCRCYGCG

SEQ ID NO: 603 - protein, 63 aa, Artificial Sequence
  Description of Artificial Sequence: Synthetic polypeptide
GSMNARLIYLLLVVTTMTLMFDTAQAVDIMCSGPRQCYGPCRRETGCPNARCMNRRCRCYGCV

SEQ ID NO: 604 - protein, 64 aa, Artificial Sequence
  Description of Artificial Sequence: Synthetic polypeptide
GSMNARLIYLLLVVTTMMLTFDTTQAGDIRCSGTRQCWGPCRRQTTCTNSRCMNGRCRCYGCVG

SEQ ID NO: 605 - protein, 63 aa, Artificial Sequence
  Description of Artificial Sequence: Synthetic polypeptide
GSMNTRFIFLLLVVTNTMMLFDTRPVEGISCTGSRQCYDPCRRRTGCPNARCMNRSCRCYGCG

SEQ ID NO: 606 - protein, 40 aa, Artificial Sequence
  Description of Artificial Sequence: Synthetic polypeptide
GSGVPINVRCSGSRDCLEPCRRAGMRFGRCINRRCHCTPR

SEQ ID NO: 607 - protein, 40 aa, Artificial Sequence
  Description of Artificial Sequence: Synthetic polypeptide
GSGVPINVRCTGSPQCLRPCRDAGMRFGRCINGRCHCTPR

SEQ ID NO: 608 - protein, 40 aa, Artificial Sequence
  Description of Artificial Sequence: Synthetic polypeptide
GSGVIINVRCRISRQCLEPCRRAGMRFGRCMNGRCHCTPR

SEQ ID NO: 609 - protein, 40 aa, Artificial Sequence
  Description of Artificial Sequence: Synthetic polypeptide
GSGVPINVRCRGSPQCIQPCRDAGMRFGRCMNGRCHCTPQ

SEQ ID NO: 610 - protein, 40 aa, Artificial Sequence
  Description of Artificial Sequence: Synthetic polypeptide
GSGVEINVRCTGSHQCIRPCRDAGMRFGRCINRRCHCTPR

SEQ ID NO: 611 - protein, 40 aa, Artificial Sequence
  Description of Artificial Sequence: Synthetic polypeptide
GSGVEINVRCSGSPQCLRPCRDAGMRFGRCMNRRCHCTPR

SEQ ID NO: 612 - protein, 40 aa, Artificial Sequence
  Description of Artificial Sequence: Synthetic polypeptide
GSGVPTDVRCRGSPQCIQPCRDAGMRFGRCMNGRCHCTPR

SEQ ID NO: 613 - protein, 40 aa, Artificial Sequence
  Description of Artificial Sequence: Synthetic polypeptide
GSGVPINVSCTGSPQCIRPCRDAGMRFGRCMNRRCHCTPR

SEQ ID NO: 614 - protein, 40 aa, Artificial Sequence
  Description of Artificial Sequence: Synthetic polypeptide
GSGVPINVPCTGSPQCIRPCRDAGMRFGRCMNRRCHCTPR

SEQ ID NO: 615 - protein, 39 aa, Artificial Sequence
  Description of Artificial Sequence: Synthetic polypeptide
GSVGINVRCRHSGQCLRPCRDAGMRFGRCINGRCDCTPR

SEQ ID NO: 616 - protein, 39 aa, Artificial Sequence
  Description of Artificial Sequence: Synthetic polypeptide
GSVGINVRCRHSGQCLRPCRDAGMRFGRCMNGRCDCTPR

SEQ ID NO: 617 - protein, 39 aa, Artificial Sequence
  Description of Artificial Sequence: Synthetic polypeptide
GSVGIPVSCRHSGQCIRPCRDAGMRFGRCMNRRCDCTPR

SEQ ID NO: 618 - protein, 38 aa, Artificial Sequence
  Description of Artificial Sequence: Synthetic polypeptide
GSRRGCFREGHSCPRTAPCCRPLVCRGPSPNTRRCTRP

SEQ ID NO: 619 - protein, 34 aa, Artificial Sequence
  Description of Artificial Sequence: Synthetic polypeptide
GSSFCIPFRPCRSDENCCRRFRCRTTGIVRLCRW

SEQ ID NO: 620 - protein, 38 aa, Artificial Sequence
  Description of Artificial Sequence: Synthetic polypeptide
GSLRGCLPRNRFCNALSGPRCCSGLRCRELSIWASRCL

SEQ ID NO: 621 - protein, 36 aa, Artificial Sequence
  Description of Artificial Sequence: Synthetic polypeptide
GSGNYCLRGRCLPGGRRCCNGRPCECFARICSCRPR

SEQ ID NO: 622 - protein, 31 aa, Artificial Sequence
  Description of Artificial Sequence: Synthetic polypeptide
GSTVRCGGCNRRCCPGGCRSGRCINGRCQCY

SEQ ID NO: 623 - protein, 31 aa, Artificial Sequence
  Description of Artificial Sequence: Synthetic polypeptide
GSGCMREYCAGQCRGRVSQDYCLRHCRCIPR

SEQ ID NO: 624 - protein, 36 aa, Artificial Sequence
  Description of Artificial Sequence: Synthetic polypeptide
GSACLGFGERCNPSNDRCCRSSSLVCSQRHRWCRYG

SEQ ID NO: 625 - protein, 39 aa, Artificial Sequence
  Description of Artificial Sequence: Synthetic polypeptide
GSRGGCLPHNRFCNALSGPRCCSGLRCRELSIRDSRCLG

SEQ ID NO: 626 - protein, 38 aa, Artificial Sequence
  Description of Artificial Sequence: Synthetic polypeptide
GSRGGCLPRNRFCNPSSGPRCCSGLTCRELNIWASRCL

SEQ ID NO: 627 - protein, 35 aa, Artificial Sequence
  Description of Artificial Sequence: Synthetic polypeptide
GSQRSCARPGDMCMGIRCCDGQCGCNRGTGRCFCR

SEQ ID NO: 628 - protein, 42 aa, Artificial Sequence
  Description of Artificial Sequence: Synthetic polypeptide
GSARGCADAYRSCNHPRTCCDGYNGYRRACICSGSNCRCRRS

SEQ ID NO: 629 - protein, 39 aa, Artificial Sequence
  Description of Artificial Sequence: Synthetic polypeptide
GSRGGCLPHNRFCNALSGPRCCSGLRCRELSIWDSRCLG

SEQ ID NO: 630 - protein, 39 aa, Artificial Sequence
  Description of Artificial Sequence: Synthetic polypeptide
GSRGGCLPHNRFCNALSGPRCCSGLRCRELSIYDSRCLG

SEQ ID NO: 631 - protein, 39 aa, Artificial Sequence
  Description of Artificial Sequence: Synthetic polypeptide
GSRGGCLPHNRFCNALSGPRCCSRLRCRELSIWDSRCLG

SEQ ID NO: 632 - protein, 39 aa, Artificial Sequence
  Description of Artificial Sequence: Synthetic polypeptide
GSRGGCLPHNRFCNALTGPRCCSRLRCRELSIWDSICLG

SEQ ID NO: 633 - protein, 36 aa, Artificial Sequence
  Description of Artificial Sequence: Synthetic polypeptide
GSSCADAYKSCDSLRCCNNRTCMCSMIGTNCTCRRR

SEQ ID NO: 634 - protein, 32 aa, Artificial Sequence
  Description of Artificial Sequence: Synthetic polypeptide
GSERRCLPAGRTCVRGPMRVPCCGSCSQNRCT

SEQ ID NO: 635 - protein, 33 aa, Artificial Sequence
  Description of Artificial Sequence: Synthetic polypeptide
GSLCSREGEFCYRLRRCCAGFYCRAFVLHCYRN

SEQ ID NO: 636 - protein, 25 aa, Artificial Sequence
  Description of Artificial Sequence: Synthetic peptide
GSACGSCRRRCRGSGRCINGRCRCY

SEQ ID NO: 637 - protein, 25 aa, Artificial Sequence
  Description of Artificial Sequence: Synthetic peptide
GSACGSCRRRCRGPGRCINGRCRCY

SEQ ID NO: 638 - protein, 34 aa, Artificial Sequence
  Description of Artificial Sequence: Synthetic polypeptide
GSACQGYMRRCGRDRPPCCRRLECSRTWRWCVWN

SEQ ID NO: 639 - protein, 32 aa, Artificial Sequence
  Description of Artificial Sequence: Synthetic polypeptide
GSGRYCQRWMWTCDSRRACCEGLRCRLWCRRI

SEQ ID NO: 640 - protein, 36 aa, Artificial Sequence
  Description of Artificial Sequence: Synthetic polypeptide
GSNARCRGSPECLPRCREAIGRAAGRCMNGRCRCYP

SEQ ID NO: 641 - protein, 36 aa, Artificial Sequence
  Description of Artificial Sequence: Synthetic polypeptide
GSNVRCRGSRECLPACRAAVGRAAGRCMNGRCRCYP

SEQ ID NO: 642 - protein, 36 aa, Artificial Sequence
  Description of Artificial Sequence: Synthetic polypeptide
GSNVRCRGSPECLPRCREAIGRSAGRCMNGRCRCYP

SEQ ID NO: 643 - protein, 36 aa, Artificial Sequence
  Description of Artificial Sequence: Synthetic polypeptide
GSNARCRGSPECLPRCRQAIGRAAGRCMNGRCRCYP

SEQ ID NO: 644 - protein, 35 aa, Artificial Sequence
  Description of Artificial Sequence: Synthetic polypeptide
GSRGYCAERGIRCHNIHCCSGLTCRCRGSSCVCRR

SEQ ID NO: 645 - protein, 33 aa, Artificial Sequence
  Description of Artificial Sequence: Synthetic polypeptide
GSERGCRLTFWRCRNRRECCGWNACALGICMPR

SEQ ID NO: 646 - protein, 41 aa, Artificial Sequence
  Description of Artificial Sequence: Synthetic polypeptide
GSRRRCIARDYGRCRWGGTPCCRGRGCICSIMGTNCECRPR

SEQ ID NO: 647 - protein, 31 aa, Artificial Sequence
  Description of Artificial Sequence: Synthetic polypeptide
GSGCRLTFWRCRNRRECCGWNACALGICMPR

SEQ ID NO: 648 - protein, 34 aa, Artificial Sequence
  Description of Artificial Sequence: Synthetic polypeptide
GSACRGLFVTCTPGRDECCPNHVCSSRHRWCRYR

SEQ ID NO: 649 - protein, 38 aa, Artificial Sequence
  Description of Artificial Sequence: Synthetic polypeptide
GSIACAPRGLLCFRDRECCRGLTCRGRFVNTWPTFCLV

SEQ ID NO: 650 - protein, 38 aa, Artificial Sequence
  Description of Artificial Sequence: Synthetic polypeptide
GSACAGLYRRCGRGVNTCCENRPCRCDLAMGNCICRRR

SEQ ID NO: 651 - protein, 40 aa, Artificial Sequence
  Description of Artificial Sequence: Synthetic polypeptide
GSFTCAISCDIRVNGRPCRGSGERRCSGGWSCRFNVCVRV

SEQ ID NO: 652 - protein, 35 aa, Artificial Sequence
  Description of Artificial Sequence: Synthetic polypeptide
GSGFCAQRGIRCHDIHCCTNLRCVREGSNRVCRRA

SEQ ID NO: 653 - protein, 44 aa, Artificial Sequence
  Description of Artificial Sequence: Synthetic polypeptide
GSCARRRNWCGRNEDCCCPMRCIYAWYNQQGSCQSTITGLFRRC

SEQ ID NO: 654 - protein, 30 aa, Artificial Sequence
  Description of Artificial Sequence: Synthetic polypeptide
GSYCQRWMWTCDSARRCCEGLVCRLWCRRI

SEQ ID NO: 655 - protein, 39 aa, Artificial Sequence
  Description of Artificial Sequence: Synthetic polypeptide
GSRGGCLPHNRFCNALSGPRCCSGLRCRELTIWNTRCLE

SEQ ID NO: 656 - protein, 36 aa, Artificial Sequence
  Description of Artificial Sequence: Synthetic polypeptide
GSNVRCTGSRQCLPACRAAVGRAAGRCMNGRCRCYT

SEQ ID NO: 657 - protein, 35 aa, Artificial Sequence
  Description of Artificial Sequence: Synthetic polypeptide
GSQRSCARPGEMCMRIRCCDGQCGCNRGTGRCFCR

SEQ ID NO: 658 - protein, 38 aa, Artificial Sequence
  Description of Artificial Sequence: Synthetic polypeptide
GSGCIPRHRRCTWSGPRCCNNISCHCNISGTLCRCRPG

SEQ ID NO: 659 - protein, 35 aa, Artificial Sequence
  Description of Artificial Sequence: Synthetic polypeptide
GSNYCVARRCRPGGRQCCSGRPCACVGRVCRCPRD

SEQ ID NO: 660 - protein, 39 aa, Artificial Sequence
  Description of Artificial Sequence: Synthetic polypeptide
GSERGCSGAYRRCSSSQRCCEGRPCVCSAINSNCRCRRT

SEQ ID NO: 661 - protein, 35 aa, Artificial Sequence
  Description of Artificial Sequence: Synthetic polypeptide
GSQRSCARPGEMCMGIRCCDGQCGCNRGTGRCFCR

SEQ ID NO: 662 - protein, 38 aa, Artificial Sequence
  Description of Artificial Sequence: Synthetic polypeptide
GSRRGCFREGRWCPRSAPCCAPLRCRGPSIRQQRCVRE

SEQ ID NO: 663 - protein, 33 aa, Artificial Sequence
  Description of Artificial Sequence: Synthetic polypeptide
GSTVRCGGCNRRCCAGGCRSGRCINGRCQCYGR

SEQ ID NO: 664 - protein, 31 aa, Artificial Sequence
  Description of Artificial Sequence: Synthetic polypeptide
GSERRCEPSGRPCRPLMRIPCCGSCVRGRCA

SEQ ID NO: 665 - protein, 38 aa, Artificial Sequence
  Description of Artificial Sequence: Synthetic polypeptide
GSRGGCLPRNRFCNPSSGPRCCSGLTCRELNIWANRCL

SEQ ID NO: 666 - protein, 44 aa, Artificial Sequence
  Description of Artificial Sequence: Synthetic polypeptide
GSCARRRNWCGRNEDCCCPMRCIYAWYNQQGSCQTTITGLFRRC

SEQ ID NO: 667 - protein, 39 aa, Artificial Sequence
  Description of Artificial Sequence: Synthetic polypeptide
GSVRIPVSCRHSGQCLRPCRDAGMRTGRCMNGRCDCTPR

SEQ ID NO: 668 - protein, 40 aa, Artificial Sequence
  Description of Artificial Sequence: Synthetic polypeptide
GSQKILSNRCNNSSECIPHCIRIFGTRAAKCINRKCYCYP

SEQ ID NO: 669 - protein, 34 aa, Artificial Sequence
  Description of Artificial Sequence: Synthetic polypeptide
GSAVCNLKRCQLSCRSLGLLGKCIGDKCECVKHG

SEQ ID NO: 670 - protein, 39 aa, Artificial Sequence
  Description of Artificial Sequence: Synthetic polypeptide
GSISIGIRCSPSIDLCEGQCRIRRYFTGYCSGDTCHCSG

SEQ ID NO: 671 - protein, 35 aa, Artificial Sequence
  Description of Artificial Sequence: Synthetic polypeptide
GSGDCLPHLRRCRENNDCCSRRCRRRGANPERRCR

SEQ ID NO: 672 - protein, 36 aa, Artificial Sequence
  Description of Artificial Sequence: Synthetic polypeptide
GSSCEPGRTFRDRCNTCKCGADGRSAACTLRACPNQ

SEQ ID NO: 673 - protein, 35 aa, Artificial Sequence
  Description of Artificial Sequence: Synthetic polypeptide
GSGDCLPHLKRCKADNDCCGKKCKRRGTNAEKRCR

SEQ ID NO: 674 - protein, 35 aa, Artificial Sequence
  Description of Artificial Sequence: Synthetic polypeptide
GSGDCLPHLKRCKENNDCCSKKCKRRGTNPEKRCR

SEQ ID NO: 675 - protein, 35 aa, Artificial Sequence
  Description of Artificial Sequence: Synthetic polypeptide
GSKDCLKKLKLCKENKDCCSKSCKRRGTNIEKRCR

SEQ ID NO: 676 - protein, 35 aa, Artificial Sequence
  Description of Artificial Sequence: Synthetic polypeptide
GSGDCLPHLKRCKENNDCCSKKCKRRGANPEKRCR

SEQ ID NO: 677 - protein, 39 aa, Artificial Sequence
  Description of Artificial Sequence: Synthetic polypeptide
GSVFINVKCRGSPECLPKCKEAIGKSAGKCMNGKCKCYP

SEQ ID NO: 678 - protein, 39 aa, Artificial Sequence
  Description of Artificial Sequence: Synthetic polypeptide
GSVFINAKCRGSPECLPKCKEAIGKAAGKCMNGKCKCYP

SEQ ID NO: 679 - protein, 38 aa, Artificial Sequence
  Description of Artificial Sequence: Synthetic polypeptide
GSVIINVKCKISRQCLEPCKKAGMRFGKCMNGKCHCTP

SEQ ID NO: 680 - protein, 38 aa, Artificial Sequence
  Description of Artificial Sequence: Synthetic polypeptide
GSVPTDVKCRGSPQCIQPCKDAGMRFGKCMNGKCHCTP

SEQ ID NO: 681 - protein, 38 aa, Artificial Sequence
  Description of Artificial Sequence: Synthetic polypeptide
GSVRIPVSCKHSGQCLKPCKDAGMRFGKCMNGKCDCTP

SEQ ID NO: 682 - protein, 38 aa, Artificial Sequence
  Description of Artificial Sequence: Synthetic polypeptide
GSVRIPVSCRHSGQCLRPCRDAGMRFGRCMNGRCDCTP

SEQ ID NO: 683 - protein, 35 aa, Artificial Sequence
  Description of Artificial Sequence: Synthetic polypeptide
GSTNVSCTTSKECWSVCQRLHNTSRGKCMNKKCRC

SEQ ID NO: 684 - protein, 34 aa, Artificial Sequence
  Description of Artificial Sequence: Synthetic polypeptide
GSNVKCTGSKQCLPACKAAVGKAAGKCMNGKCKC

SEQ ID NO: 685 - protein, 39 aa, Artificial Sequence
  Description of Artificial Sequence: Synthetic polypeptide
GSGVPINVRCRGSRDCLDPCRGAGERHGRCGNSRCHCTP

SEQ ID NO: 686 - protein, 39 aa, Artificial Sequence
  Description of Artificial Sequence: Synthetic polypeptide
GSVRIPVSCRHSGQCLRPCRDAGERHGRCGGGRCDCTPR

SEQ ID NO: 687 - protein, 40 aa, Artificial Sequence
  Description of Artificial Sequence: Synthetic polypeptide
GSQVQTNVRCQGGSCGSVCRREGGGAGGGCGNGRCGCYRN

SEQ ID NO: 688 - protein, 34 aa, Artificial Sequence
  Description of Artificial Sequence: Synthetic polypeptide
GSIKCSESYQCFPVCKSRFGKTNGRCVNGFCDCF

SEQ ID NO: 689 - protein, 35 aa, Artificial Sequence
  Description of Artificial Sequence: Synthetic polypeptide
GSVKCSSPQQCLKPCKAAFGISAGGKCINGKCKCY

SEQ ID NO: 690 - protein, 34 aa, Artificial Sequence
  Description of Artificial Sequence: Synthetic polypeptide
GSVSCSASSQCWPVCKKLFGTYRGKCMNSKCRCY

SEQ ID NO: 691 - protein, 34 aa, Artificial Sequence
  Description of Artificial Sequence: Synthetic polypeptide
GSESCTASNQCWSICKRLHNTNRGKCMNKKCRCY

SEQ ID NO: 692 - protein, 34 aa, Artificial Sequence
  Description of Artificial Sequence: Synthetic polypeptide
GSVSCTTSKECWSVCEKLYNTSRGKCMNKKCRCY

SEQ ID NO: 693 - protein, 34 aa, Artificial Sequence
  Description of Artificial Sequence: Synthetic polypeptide
GSMRCKSSKECLVKCKQATGRPNGKCMNRKCKCY

SEQ ID NO: 694 - protein, 34 aa, Artificial Sequence
  Description of Artificial Sequence: Synthetic polypeptide
GSIKCTLSKDCYSPCKKETGCPRAKCINRNCKCY

SEQ ID NO: 695 - protein, 34 aa, Artificial Sequence
  Description of Artificial Sequence: Synthetic polypeptide
GSIRCSGSRDCYSPCMKQTGCPNAKCINKSCKCY

SEQ ID NO: 696 - protein, 34 aa, Artificial Sequence
  Description of Artificial Sequence: Synthetic polypeptide
GSIRCSGTRECYAPCQKLTGCLNAKCMNKACKCY

SEQ ID NO: 697 - protein, 34 aa, Artificial Sequence
  Description of Artificial Sequence: Synthetic polypeptide
GSISCTNPKQCYPHCKKETGYPNAKCMNRKCKCF

SEQ ID NO: 698 - protein, 34 aa, Artificial Sequence
  Description of Artificial Sequence: Synthetic polypeptide
GSASCRTPKDCADPCRKETGCPYGKCMNRKCKCN

SEQ ID NO: 699 - protein, 33 aa, Artificial Sequence
  Description of Artificial Sequence: Synthetic polypeptide
GSTSCISPKQCTEPCRAKGCKHGKCMNRKCHCM

SEQ ID NO: 700 - protein, 33 aa, Artificial Sequence
  Description of Artificial Sequence: Synthetic polypeptide
GSKECTGPQHCTNFCRKNKCTHGKCMNRKCKCF

SEQ ID NO: 701 - protein, 34 aa, Artificial Sequence
  Description of Artificial Sequence: Synthetic polypeptide
GSIKCRTPKDCADPCRKQTGCPHAKCMNKTCRCH

SEQ ID NO: 702 - protein, 34 aa, Artificial Sequence
  Description of Artificial Sequence: Synthetic polypeptide
GSVKCTTSKECWPPCKAATGKAAGKCMNKKCKCQ

SEQ ID NO: 703 - protein, 34 aa, Artificial Sequence
  Description of Artificial Sequence: Synthetic polypeptide
GSLECGASRECYDPCFKAFGRAHGKCMNNKCRCY

SEQ ID NO: 704 - protein, 34 aa, Artificial Sequence
  Description of Artificial Sequence: Synthetic polypeptide
GSEKCFATSQCWTPCKKAIGSLQSKCMNGKCKCY

SEQ ID NO: 705 - protein, 34 aa, Artificial Sequence
  Description of Artificial Sequence: Synthetic polypeptide
GSVRCYASRECWEPCRRVTGSAQAKCQNNQCRCY

SEQ ID NO: 706 - protein, 34 aa, Artificial Sequence
  Description of Artificial Sequence: Synthetic polypeptide
GSVKCSASRECWVACKKVTGSGQGKCQNNQCRCY

SEQ ID NO: 707 - protein, 34 aa, Artificial Sequence
  Description of Artificial Sequence: Synthetic polypeptide
GSVKCISSQECWIACKKVTGRFEGKCQNRQCRCY

SEQ ID NO: 708 - protein, 34 aa, Artificial Sequence
  Description of Artificial Sequence: Synthetic polypeptide
GSVRCYDSRQCWIACKKVTGSTQGKCQNKQCRCY

SEQ ID NO: 709 - protein, 34 aa, Artificial Sequence
  Description of Artificial Sequence: Synthetic polypeptide
GSVDCTVSKECWAPCKAAFGVDRGKCMGKKCKCY

SEQ ID NO: 710 - protein, 34 aa, Artificial Sequence
  Description of Artificial Sequence: Synthetic polypeptide
GSAKCRGSPECLPKCKEAIGKAAGKCMNGKCKCY

SEQ ID NO: 711 - protein, 33 aa, Artificial Sequence
  Description of Artificial Sequence: Synthetic polypeptide
GSKKCQGGSCASVCRRVIGVAAGKCINGRCVCY

SEQ ID NO: 712 - protein, 34 aa, Artificial Sequence
  Description of Artificial Sequence: Synthetic polypeptide
GSKKCSNTSQCYKTCEKVVGVAAGKCMNGKCICY

SEQ ID NO: 713 - protein, 34 aa, Artificial Sequence
  Description of Artificial Sequence: Synthetic polypeptide
GSVKCSGSSKCVKICIDRYNTRGAKCINGRCTCY

SEQ ID NO: 714 - protein, 34 aa, Artificial Sequence
  Description of Artificial Sequence: Synthetic polypeptide
GSNRCNNSSECIPHCIRIFGTRAAKCINRKCYCY

SEQ ID NO: 715 - protein, 34 aa, Artificial Sequence
  Description of Artificial Sequence: Synthetic polypeptide
GSKECNGSSECYSHCEGITGKRSGKCINKKCYCY

SEQ ID NO: 716 - protein, 31 aa, Artificial Sequence
  Description of Artificial Sequence: Synthetic polypeptide
GSAFCNLRRCELSCRSLGLLGKCIGEECKCV

SEQ ID NO: 717 - protein, 31 aa, Artificial Sequence
  Description of Artificial Sequence: Synthetic polypeptide
GSAVCNLKRCQLSCRSLGLLGKCIGDKCECV

SEQ ID NO: 718 - protein, 32 aa, Artificial Sequence
  Description of Artificial Sequence: Synthetic polypeptide
GSAACYSSDCRVKCVAMGFSSGKCINSKCKCY

SEQ ID NO: 719 - protein, 29 aa, Artificial Sequence
  Description of Artificial Sequence: Synthetic peptide
GSAICATDADCSRKCPGNPPCRNGFCACT

SEQ ID NO: 720 - protein, 29 aa, Artificial Sequence
  Description of Artificial Sequence: Synthetic peptide
GSTECQIKNDCQRYCQSVKECKYGKCYCN

SEQ ID NO: 721 - protein, 29 aa, Artificial Sequence
  Description of Artificial Sequence: Synthetic peptide
GSTQCQSVRDCQQYCLTPDRCSYGTCYCK

SEQ ID NO: 722 - protein, 34 aa, Artificial Sequence
  Description of Artificial Sequence: Synthetic polypeptide
GSVSCRYGSDCAEPCKRLKCLLPSKCINGKCTCY

SEQ ID NO: 723 - protein, 34 aa, Artificial Sequence
  Description of Artificial Sequence: Synthetic polypeptide
GSIKCRYPADCHIMCRKVTGRAEGKCMNGKCTCY

SEQ ID NO: 724 - protein, 34 aa, Artificial Sequence
  Description of Artificial Sequence: Synthetic polypeptide
GSIKCSSSSSCYEPCRGVTGRAHGKCMNGRCTCY

SEQ ID NO: 725 - protein, 34 aa, Artificial Sequence
  Description of Artificial Sequence: Synthetic polypeptide
GSVKCTGSKQCLPACKAAVGKAAGKCMNGKCKCY

SEQ ID NO: 726 - protein, 33 aa, Artificial Sequence
  Description of Artificial Sequence: Synthetic polypeptide
GSVSCKHSGQCIKPCKDAGMRFGKCMNRKCDCT

SEQ ID NO: 727 - protein, 33 aa, Artificial Sequence
  Description of Artificial Sequence: Synthetic polypeptide
GSVKCRGSPQCIQPCRDAGMRFGKCMNGKCHCT

SEQ ID NO: 728 - protein, 35 aa, Artificial Sequence
  Description of Artificial Sequence: Synthetic polypeptide
GSVKCTSPKQCLPPCKAQFGIRAGAKCMNGKCKCY

SEQ ID NO: 729 - protein, 35 aa, Artificial Sequence
  Description of Artificial Sequence: Synthetic polypeptide
GSVKCTSPKQCSKPCKELYGSSAGAKCMNGKCKCY

SEQ ID NO: 730 - protein, 35 aa, Artificial Sequence
  Description of Artificial Sequence: Synthetic polypeptide
GSVKCTSPKQCLPPCKEIYGRHAGAKCMNGKCHCS

SEQ ID NO: 731 - protein, 34 aa, Artificial Sequence
  Description of Artificial Sequence: Synthetic polypeptide
GSVKCTGSKQCWPVCKQMFGKPNGKCMNGKCRCY

SEQ ID NO: 732 - protein, 33 aa, Artificial Sequence
  Description of Artificial Sequence: Synthetic polypeptide
GSVKCRGSRDCLDPCKKAGMRFGKCINSKCHCT

SEQ ID NO: 733 - protein, 29 aa, Artificial Sequence
  Description of Artificial Sequence: Synthetic peptide
GSVRCVTDDDCFRKCPGNPSCKRGFCACK

SEQ ID NO: 734 - protein, 34 aa, Artificial Sequence
  Description of Artificial Sequence: Synthetic polypeptide
GSVPCNNSRPCVPVCIREVNNKNGKCSNGKCLCY

SEQ ID NO: 735 - protein, 38 aa, Artificial Sequence
  Description of Artificial Sequence: Synthetic polypeptide
GSVPINVKCRGSRDCLDPCKKAGMRFGKCINSKCHCTP

SEQ ID NO: 736 - protein, 39 aa, Artificial Sequence
  Description of Artificial Sequence: Synthetic polypeptide
GSVQTNVKCQGGSCASVCRREIGVAAGKCINGKCVCYRN

SEQ ID NO: 737 - protein, 40 aa, Artificial Sequence
  Description of Artificial Sequence: Synthetic polypeptide
GSAEIIRCSGTRECYAPCQKLTGCLNAKCMNKACKCYGCV

SEQ ID NO: 738 - protein, 38 aa, Artificial Sequence
  Description of Artificial Sequence: Synthetic polypeptide
GSRPTDIKCSASYQCFPVCKSRFGKTNGRCVNGLCDCF

SEQ ID NO: 739 - protein, 39 aa, Artificial Sequence
  Description of Artificial Sequence: Synthetic polypeptide
GSQFTDVKCTGSKQCWPVCKQMFGKPNGKCMNGKCRCYS

SEQ ID NO: 740 - protein, 39 aa, Artificial Sequence
  Description of Artificial Sequence: Synthetic polypeptide
GSVGINVKCKHSRQCLKPCKDAGMRFGKCTNGKCHCTPK

SEQ ID NO: 741 - protein, 37 aa, Artificial Sequence
  Description of Artificial Sequence: Synthetic polypeptide
GSVVIGQRCYRSPDCYSACKKLVGKATGKCTNGRCDC

SEQ ID NO: 742 - protein, 37 aa, Artificial Sequence
  Description of Artificial Sequence: Synthetic polypeptide
GSNFKVEGACSKPCRKYCIDKGARNGKCINGRCHCYY

SEQ ID NO: 743 - protein, 40 aa, Artificial Sequence
  Description of Artificial Sequence: Synthetic polypeptide
GSQIDTNVKCSGSSKCVKICIDRYNTRGAKCINGRCTCYP

SEQ ID NO: 744 - protein, 39 aa, Artificial Sequence
  Description of Artificial Sequence: Synthetic polypeptide
GSGVPISVRCRGSRDCLEPCRRAGTRFGRCINGRCHCTP

SEQ ID NO: 745 - protein, 39 aa, Artificial Sequence
  Description of Artificial Sequence: Synthetic polypeptide
GSGVPISVRCRGSRDCLEPCRRAGTRFGRCIQSRCHCTP

SEQ ID NO: 746 - protein, 39 aa, Artificial Sequence
  Description of Artificial Sequence: Synthetic polypeptide
GSGVPISVRCRGSRDCLEPCRRAGTRFGRCINRRCHCTP

SEQ ID NO: 747 - protein, 39 aa, Artificial Sequence
  Description of Artificial Sequence: Synthetic polypeptide
GSGVPINVRCRGSRDCLEPCRRAGTRFGRCINSRCHCTP

SEQ ID NO: 748 - protein, 39 aa, Artificial Sequence
  Description of Artificial Sequence: Synthetic polypeptide
GSGVPINVRCRGSRDCLEPCRRAGTRFGRCIQSRCHCTP

SEQ ID NO: 749 - protein, 39 aa, Artificial Sequence
  Description of Artificial Sequence: Synthetic polypeptide
GSGVPINVRCRGSRDCLEPCRRAGTRFGRCIQSRCHCYP

SEQ ID NO: 750 - protein, 39 aa, Artificial Sequence
  Description of Artificial Sequence: Synthetic polypeptide
GSGVPINVRCRGSRDCYEPCRRAGTRFGRCIQSRCHCTP

SEQ ID NO: 751 - protein, 39 aa, Artificial Sequence
  Description of Artificial Sequence: Synthetic polypeptide
GSGVPINVRCRGSRDCLEPCRRAGTRFGRCIQSRCYCTP

SEQ ID NO: 752 - protein, 39 aa, Artificial Sequence
  Description of Artificial Sequence: Synthetic polypeptide
GSGVPISVRCRGSRDCLEPCRRAGTRFGRCIQSRCHCYP

SEQ ID NO: 753 - protein, 39 aa, Artificial Sequence
  Description of Artificial Sequence: Synthetic polypeptide
GSGVPISVRCRGSRDCYEPCRRAGTRFGRCIQSRCHCTP

SEQ ID NO: 754 - protein, 39 aa, Artificial Sequence
  Description of Artificial Sequence: Synthetic polypeptide
GSGVPISVRCRGSRDCLEPCRRAGTRFGRCIQSRCYCTP

SEQ ID NO: 755 - protein, 39 aa, Artificial Sequence
  Description of Artificial Sequence: Synthetic polypeptide
GSGVPINVRCRGSRDCLEPCRRAGTRFGRCIASRCHCYP

SEQ ID NO: 756 - protein, 39 aa, Artificial Sequence
  Description of Artificial Sequence: Synthetic polypeptide
GSGVPINVRCRGSRDCLEPCRRAGTRFGRCISSRCHCYP

SEQ ID NO: 757 - protein, 39 aa, Artificial Sequence
  Description of Artificial Sequence: Synthetic polypeptide
GSGVPINVRCRGSRDCLEPCRRAGTRFGRCITSRCHCYP

SEQ ID NO: 758 - protein, 39 aa, Artificial Sequence
  Description of Artificial Sequence: Synthetic polypeptide
GSGVPINVRCRGSRDCLEPCRRAGTRFGRCINSRCHCYP

SEQ ID NO: 759 - protein, 40 aa, Artificial Sequence
  Description of Artificial Sequence: Synthetic polypeptide
  MOD_RES (3)..(3): Any amino acid, amino acid analogue or null
  MOD_RES (5)..(6): Any amino acid, amino acid analogue or null
  MOD_RES (9)..(9): Any amino acid, amino acid analogue or null
  MOD_RES (15)..(15): Any amino acid, amino acid analogue or null
  MOD_RES (20)..(22): Any amino acid, amino acid analogue or null
  MOD_RES (24)..(24): Any amino acid, amino acid analogue or null
  MOD_RES (26)..(26): Any amino acid, amino acid analogue or null
  MOD_RES (30)..(30): Any amino acid, amino acid analogue or null
  MOD_RES (37)..(40): Any amino acid, amino acid analogue or null
GVXIXXKCXGSKQCXDPCKXXXGXRXGKCXNKKCKCXXXX

SEQ ID NO: 760 - protein, 40 aa, Artificial Sequence
  Description of Artificial Sequence: Synthetic polypeptide
  MOD_RES (3)..(3): P or R
  MOD_RES (5)..(5): P or N
  MOD_RES (6)..(6): V or I
  MOD_RES (9)..(9): S, T, R or K
  MOD_RES (15)..(15): Y or L
  MOD_RES (20)..(20): Q, R or K
  MOD_RES (21)..(21): A, K or R
  MOD_RES (22)..(22): T or A
  MOD_RES (24)..(24): C or M
  MOD_RES (26)..(26): F or N
  MOD_RES (30)..(30): M or I
  MOD_RES (37)..(37): Y or T
  MOD_RES (38)..(38): G or P
  MISC_FEATURE (39)..(40): May or may not be present
GVXIXXKCXGSKQCXDPCKXXXGXRXGKCXNKKCKCXXCG

SEQ ID NO: 761 - protein, 39 aa, Artificial Sequence
  Description of Artificial Sequence: Synthetic polypeptide
  MOD_RES (1)..(4): Any amino acid, amino acid analogue or null
  MOD_RES (6)..(6): Any amino acid, amino acid analogue or null
  MOD_RES (8)..(8): Any amino acid, amino acid analogue or null
  MOD_RES (15)..(15): Any amino acid, amino acid analogue or null
  MOD_RES (19)..(20): Any amino acid, amino acid analogue or null
  MOD_RES (24)..(26): Any amino acid, amino acid analogue or null
  MOD_RES (29)..(30): Any amino acid, amino acid analogue or null
  MOD_RES (32)..(32): Any amino acid, amino acid analogue or null
XXXXIXCXGSKQCYXPCKXXTGCXXXKCXXKXCKCYGCG

SEQ ID NO: 762 - protein, 39 aa, Artificial Sequence
  Description of Artificial Sequence: Synthetic polypeptide
  MISC_FEATURE (1)..(2): May or may not be present
  MOD_RES (3)..(3): E, G or null
  MOD_RES (4)..(4): V, S or null
  MOD_RES (6)..(6): R or S
  MOD_RES (8)..(8): S or T
  MOD_RES (15)..(15): G or D
  MOD_RES (19)..(19): Q or R
  MOD_RES (20)..(20): Q or K
  MOD_RES (24)..(24): T or P
  MOD_RES (25)..(25): N or Q
  MOD_RES (26)..(26): S or A
  MOD_RES (29)..(29): M or L
  MOD_RES (30)..(30): N or Q
  MOD_RES (32)..(32): V or S
GSXXIXCXGSKQCYXPCKXXTGCXXXKCXXKXCKCYGCG

SEQ ID NO: 763 - protein, 40 aa, Artificial Sequence
  Description of Artificial Sequence: Synthetic polypeptide
  MOD_RES (1)..(3): Any amino acid, amino acid analogue or null
  MOD_RES (5)..(5): Any amino acid, amino acid analogue or null
  MOD_RES (7)..(7): Any amino acid, amino acid analogue or null
  MOD_RES (9)..(9): Any amino acid, amino acid analogue or null
  MOD_RES (11)..(12): Any amino acid, amino acid analogue or null
  MOD_RES (14)..(15): Any amino acid, amino acid analogue or null
  MOD_RES (18)..(18): Any amino acid, amino acid analogue or null
  MOD_RES (22)..(22): Any amino acid, amino acid analogue or null
  MOD_RES (31)..(31): Any amino acid, amino acid analogue or null
  MOD_RES (33)..(33): Any amino acid, amino acid analogue or null
  MOD_RES (36)..(36): Any amino acid, amino acid analogue or null
  MOD_RES (40)..(40): Any amino acid, amino acid analogue or null
XXXVXIXVXCXXSXXCLXPCKXAGMRFGKCXNXKCXCTPX

SEQ ID NO: 764 - protein, 40 aa, Artificial Sequence
  Description of Artificial Sequence: Synthetic polypeptide
  MISC_FEATURE (1)..(1): May or may not be present
  MOD_RES (2)..(2): G, S or null
  MOD_RES (3)..(3): G, S or null
  MOD_RES (5)..(5): P or R
  MOD_RES (7)..(7): N or P
  MOD_RES (9)..(9): K or S
  MOD_RES (11)..(11): R or K
  MOD_RES (12)..(12): G or H
  MOD_RES (14)..(14): R or G
  MOD_RES (15)..(15): D or Q
  MOD_RES (18)..(18): D or K
  MOD_RES (22)..(22): K or D
  MOD_RES (31)..(31): I or M
  MOD_RES (33)..(33): S or G
  MOD_RES (36)..(36): H or D
  MISC_FEATURE (40)..(40): May or may not be present
GXXVXIXVXCXXSXXCLXPCKXAGMRFGKCXNXKCXCTPK

SEQ ID NO: 765 - protein, 35 aa, Artificial Sequence
  Description of Artificial Sequence: Synthetic polypeptide
  MOD_RES (1)..(1): Any amino acid
  MOD_RES (3)..(3): Any amino acid
  MOD_RES (7)..(7): Any amino acid
  MOD_RES (13)..(13): Any amino acid
  MOD_RES (18)..(18): Any amino acid
  MOD_RES (20)..(20): Any amino acid
  MOD_RES (22)..(22): Any amino acid
  MOD_RES (30)..(30): Any amino acid
  MOD_RES (35)..(35): Any amino acid
  See specification as filed for detailed description of substitutions and preferred embodiments
XVXVKCXGSKQCXPCKRXGXRXGKCINKKXCKCYX

SEQ ID NO: 766 - protein, 32 aa, Artificial Sequence
  Description of Artificial Sequence: Synthetic polypeptide
  MOD_RES (1)..(1): Any amino acid
  MOD_RES (5)..(5): Any amino acid
  MOD_RES (11)..(11): Any amino acid
  MOD_RES (13)..(13): Any amino acid
  MOD_RES (16)..(16): Any amino acid
  MOD_RES (18)..(18): Any amino acid
  MOD_RES (27)..(27): Any amino acid
  MOD_RES (32)..(32): Any amino acid
  See specification as filed for detailed description of substitutions and preferred embodiments
XGCVXKCRPGXKXCCXPXKRCSRRFGXKKCKX

SEQ ID NO: 767 - protein, 41 aa, Artificial Sequence
  Description of Artificial Sequence: Synthetic polypeptide
  MOD_RES (1)..(1): Any amino acid, amino acid analogue or null
  MOD_RES (3)..(5): Any amino acid, amino acid analogue or null
  MOD_RES (9)..(9): Any amino acid, amino acid analogue or null
  MOD_RES (15)..(16): Any amino acid, amino acid analogue or null
  MOD_RES (21)..(22): Any amino acid, amino acid analogue or null
  MOD_RES (24)..(24): Any amino acid, amino acid analogue or null
  MOD_RES (26)..(26): Any amino acid, amino acid analogue or null
  MOD_RES (34)..(34): Any amino acid, amino acid analogue or null
  MOD_RES (39)..(41): Any amino acid, amino acid analogue or null
XVXXXVKCXGSKQCXXPCKRXXGXRXGKCINKKXCKCYXXX

SEQ ID NO: 768 - protein, 45 aa, Artificial Sequence
  Description of Artificial Sequence: Synthetic polypeptide
  MOD_RES (1)..(3): Any amino acid
  MOD_RES (7)..(10): Any amino acid
  MOD_RES (16)..(16): Any amino acid
  MOD_RES (18)..(18): Any amino acid
  MOD_RES (21)..(21): Any amino acid
  MOD_RES (23)..(23): Any amino acid
  MOD_RES (32)..(35): Any amino acid
  MOD_RES (40)..(45): Any amino acid
XXXGCVXXXXKCRPGXKXCCXPXKRCSRRFGXXXXKKCKXXXXXX

SEQ ID NO: 769 - protein, 40 aa, Artificial Sequence
  Description of Artificial Sequence: Synthetic polypeptide
  MOD_RES (3)..(3): Any amino acid, amino acid analogue or null
  MOD_RES (5)..(6): Any amino acid, amino acid analogue or null
  MOD_RES (9)..(9): Any amino acid, amino acid analogue or null
  MOD_RES (15)..(15): Any amino acid, amino acid analogue or null
  MOD_RES (20)..(22): Any amino acid, amino acid analogue or null
  MOD_RES (24)..(24): Any amino acid, amino acid analogue or null
  MOD_RES (26)..(26): Any amino acid, amino acid analogue or null
  MOD_RES (30)..(30): Any amino acid, amino acid analogue or null
  MOD_RES (37)..(40): Any amino acid, amino acid analogue or null
GVXIXXRCXGSRQCXDPCRXXXGXRXGRCXNRRCRCXXXX

SEQ ID NO: 770 - protein, 40 aa, Artificial Sequence
  Description of Artificial Sequence: Synthetic polypeptide
  MOD_RES (3)..(3): P or R
  MOD_RES (5)..(5): P or N
  MOD_RES (6)..(6): V or I
  MOD_RES (9)..(9): S, T, R or K
  MOD_RES (15)..(15): Y or L
  MOD_RES (20)..(20): Q, R or K
  MOD_RES (21)..(21): A, K or R
  MOD_RES (22)..(22): T or A
  MOD_RES (24)..(24): C or M
  MOD_RES (26)..(26): F or N
  MOD_RES (30)..(30): M or I
  MOD_RES (37)..(37): Y or T
  MOD_RES (38)..(38): G or P
  MISC_FEATURE (39)..(40): May or may not be present
GVXIXXRCXGSRQCXDPCRXXXGXRXGRCXNRRCRCXXCG

SEQ ID NO: 771 - protein, 39 aa, Artificial Sequence
  Description of Artificial Sequence: Synthetic polypeptide
  MOD_RES (1)..(4): Any amino acid, amino acid analogue or null
  MOD_RES (6)..(6): Any amino acid, amino acid analogue or null
  MOD_RES (8)..(8): Any amino acid, amino acid analogue or null
  MOD_RES (15)..(15): Any amino acid, amino acid analogue or null
  MOD_RES (19)..(20): Any amino acid, amino acid analogue or null
  MOD_RES (24)..(26): Any amino acid, amino acid analogue or null
  MOD_RES (29)..(30): Any amino acid, amino acid analogue or null
  MOD_RES (32)..(32): Any amino acid, amino acid analogue or null
XXXXIXCXGSRQCYXPCRXXTGCXXXRCXXRXCRCYGCG

SEQ ID NO: 772 - protein, 39 aa, Artificial Sequence
  Description of Artificial Sequence: Synthetic polypeptide
  MISC_FEATURE (1)..(2): May or may not be present
  MOD_RES (3)..(3): E, G or null
  MOD_RES (4)..(4): V, S or null
  MOD_RES (6)..(6): R or S
  MOD_RES (8)..(8): S or T
  MOD_RES (15)..(15): G or D
  MOD_RES (19)..(19): Q or R
  MOD_RES (20)..(20): Q, R or K
  MOD_RES (24)..(24): T or P
  MOD_RES (25)..(25): N or Q
  MOD_RES (26)..(26): S or A
  MOD_RES (29)..(29): M or L
  MOD_RES (30)..(30): N or Q
  MOD_RES (32)..(32): V or S
GSXXIXCXGSRQCYXPCRXXTGCXXXRCXXRXCRCYGCG

SEQ ID NO: 773 - protein, 40 aa, Artificial Sequence
  Description of Artificial Sequence: Synthetic polypeptide
  MOD_RES (1)..(3): Any amino acid, amino acid analogue or null
  MOD_RES (5)..(5): Any amino acid, amino acid analogue or null
  MOD_RES (7)..(7): Any amino acid, amino acid analogue or null
  MOD_RES (9)..(9): Any amino acid, amino acid analogue or null
  MOD_RES (11)..(12): Any amino acid, amino acid analogue or null
  MOD_RES (14)..(15): Any amino acid, amino acid analogue or null
  MOD_RES (18)..(18): Any amino acid, amino acid analogue or null
  MOD_RES (22)..(22): Any amino acid, amino acid analogue or null
  MOD_RES (31)..(31): Any amino acid, amino acid analogue or null
  MOD_RES (33)..(33): Any amino acid, amino acid analogue or null
  MOD_RES (36)..(36): Any amino acid, amino acid analogue or null
  MOD_RES (40)..(40): Any amino acid, amino acid analogue or null
XXXVXIXVXCXXSXXCLXPCRXAGMRFGRCXNXRCXCTPX

SEQ ID NO: 774 - protein, 40 aa, Artificial Sequence
  Description of Artificial Sequence: Synthetic polypeptide
  MISC_FEATURE (1)..(1): May or may not be present
  MOD_RES (2)..(2): G, S or null
  MOD_RES (3)..(3): G, S or null
  MOD_RES (5)..(5): P or R
  MOD_RES (7)..(7): N or P
  MOD_RES (9)..(9): R, K or S
  MOD_RES (11)..(11): R or K
  MOD_RES (12)..(12): G or H
  MOD_RES (14)..(14): R or G
  MOD_RES (15)..(15): D or Q
  MOD_RES (18)..(18): D, R or K
  MOD_RES (22)..(22): K, R or D
  MOD_RES (31)..(31): I or M
  MOD_RES (33)..(33): S or G
  MOD_RES (36)..(36): H or D
  MOD_RES (40)..(40): K, R or null
GXXVXIXVXCXXSXXCLXPCRXAGMRFGRCXNXRCXCTPX

SEQ ID NO: 775 - protein, 35 aa, Artificial Sequence
  Description of Artificial Sequence: Synthetic polypeptide
  MOD_RES (1)..(1): Any amino acid
  MOD_RES (3)..(3): Any amino acid
  MOD_RES (7)..(7): Any amino acid
  MOD_RES (13)..(13): Any amino acid
  MOD_RES (18)..(18): Any amino acid
  MOD_RES (20)..(20): Any amino acid
  MOD_RES (22)..(22): Any amino acid
  MOD_RES (30)..(30): Any amino acid
  MOD_RES (35)..(35): Any amino acid
  See specification as filed for detailed description of substitutions and preferred embodiments
XVXVRCXGSRQCXPCRRXGXRXGRCINRRXCRCYX

SEQ ID NO: 776 - protein, 32 aa, Artificial Sequence
  Description of Artificial Sequence: Synthetic polypeptide
  MOD_RES (1)..(1): Any amino acid
  MOD_RES (5)..(5): Any amino acid
  MOD_RES (11)..(11): Any amino acid
  MOD_RES (13)..(13): Any amino acid
  MOD_RES (16)..(16): Any amino acid
  MOD_RES (18)..(18): Any amino acid
  MOD_RES (27)..(27): Any amino acid
  MOD_RES (32)..(32): Any amino acid
  See specification as filed for detailed description of substitutions and preferred embodiments
XGCVXRCRPGXRXCCXPXRRCSRRFGXRRCRX

SEQ ID NO: 777 - protein, 41 aa, Artificial Sequence
  Description of Artificial Sequence: Synthetic polypeptide
  MOD_RES (1)..(1): Any amino acid analogue or null
  MOD_RES (3)..(5): Any amino acid analogue or null
  MOD_RES (9)..(9): Any amino acid analogue or null
  MOD_RES (15)..(16): Any amino acid analogue or null
  MOD_RES (21)..(22): Any amino acid analogue or null
  MOD_RES (24)..(24): Any amino acid analogue or null
  MOD_RES (26)..(26): Any amino acid analogue or null
  MOD_RES (34)..(34): Any amino acid analogue or null
  MOD_RES (39)..(41): Any amino acid analogue or null
XVXXXVRCXGSRQCXXPCRRXXGXRXGRCINRRXCRCYXXX

SEQ ID NO: 778 - protein, 45 aa, Artificial Sequence
  Description of Artificial Sequence: Synthetic polypeptide
  MOD_RES (1)..(3): Any amino acid analogue or null
  MOD_RES (7)..(10): Any amino acid analogue or null
  MOD_RES (16)..(16): Any amino acid analogue or null
  MOD_RES (18)..(18): Any amino acid analogue or null
  MOD_RES (21)..(21): Any amino acid analogue or null
  MOD_RES (23)..(23): Any amino acid analogue or null
  MOD_RES (32)..(35): Any amino acid analogue or null
  MOD_RES (40)..(45): Any amino acid analogue or null
XXXGCVXXXXRCRPGXRXCCXPXRRCSRRFGXXXXRRCRXXXXXX

SEQ ID NO: 779 - protein, 40 aa, Artificial Sequence
  Description of Artificial Sequence: Synthetic polypeptide
  MOD_RES (1)..(1): Any amino acid, amino acid analogue or null
  MOD_RES (3)..(3): Any amino acid, amino acid analogue or null
  MOD_RES (5)..(5): Any amino acid, amino acid analogue or null
  MOD_RES (9)..(9): Any amino acid, amino acid analogue or null
  MOD_RES (12)..(12): Any amino acid, amino acid analogue or null
  MOD_RES (16)..(16): Any amino acid, amino acid analogue or null
  MOD_RES (20)..(20): Any amino acid, amino acid analogue or null
  MOD_RES (22)..(22): Any amino acid, amino acid analogue or null
  MOD_RES (24)..(24): Any amino acid, amino acid analogue or null
  MOD_RES (26)..(26): Any amino acid, amino acid analogue or null
  MOD_RES (35)..(35): Any amino acid, amino acid analogue or null
  MOD_RES (37)..(37): Any amino acid, amino acid analogue or null
  MOD_RES (39)..(40): Any amino acid, amino acid analogue or null
XVXIXVKCXGSXQCLXPCKXAXGXRXGKCMNGKCXCXPXX

SEQ ID NO: 780 - protein, 40 aa, Artificial Sequence
  Description of Artificial Sequence: Synthetic polypeptide
  MOD_RES (1)..(1): Any amino acid, amino acid analogue or null
  MOD_RES (3)..(3): Any amino acid, amino acid analogue or null
  MOD_RES (5)..(5): Any amino acid, amino acid analogue or null
  MOD_RES (9)..(9): Any amino acid, amino acid analogue or null
  MOD_RES (12)..(12): Any amino acid, amino acid analogue or null
  MOD_RES (16)..(16): Any amino acid, amino acid analogue or null
  MOD_RES (20)..(20): Any amino acid, amino acid analogue or null
  MOD_RES (22)..(22): Any amino acid, amino acid analogue or null
  MOD_RES (24)..(24): Any amino acid, amino acid analogue or null
  MOD_RES (26)..(26): Any amino acid, amino acid analogue or null
  MOD_RES (35)..(35): Any amino acid, amino acid analogue or null
  MOD_RES (37)..(37): Any amino acid, amino acid analogue or null
  MOD_RES (39)..(40): Any amino acid, amino acid analogue or null
XVXIXVRCXGSXQCLXPCRXAXGXRXGRCMNGRCXCXPXX

SEQ ID NO: 781 - protein, 37 aa, Artificial Sequence
  Description of Artificial Sequence: Synthetic polypeptide
  MOD_RES (5)..(5): N, S or G
  MOD_RES (15)..(15): L or Y
  MOD_RES (16)..(16): D or E
  MOD_RES (23)..(23): M or T
  MOD_RES (30)..(30): N, Q, A, S, T or L
  MOD_RES (31)..(31): S, G or R
  MOD_RES (34)..(34): H or Y
  MOD_RES (36)..(36): T or Y
GVPIXVRCRGSRDCXXPCRRAGXRFGRCIXXRCXCXP

SEQ ID NO: 782 - protein, 10 aa, Artificial Sequence
  Description of Artificial Sequence: Synthetic peptide
GKCINKKCKC

SEQ ID NO: 783 - protein, 4 aa, Artificial Sequence
  Description of Artificial Sequence: Synthetic peptide
KCIN

SEQ ID NO: 784 - protein, 4 aa, Artificial Sequence
  Description of Artificial Sequence: Synthetic peptide
KKCK

SEQ ID NO: 785 - protein, 4 aa, Artificial Sequence
  Description of Artificial Sequence: Synthetic peptide
PCKR

SEQ ID NO: 786 - protein, 6 aa, Artificial Sequence
  Description of Artificial Sequence: Synthetic peptide
KRCSRR

SEQ ID NO: 787 - protein, 3 aa, Artificial Sequence
  Description of Artificial Sequence: Synthetic peptide
KQC

SEQ ID NO: 788 - protein, 10 aa, Artificial Sequence
  Description of Artificial Sequence: Synthetic peptide
GRCINRRCRC

SEQ ID NO: 789 - protein, 4 aa, Artificial Sequence
  Description of Artificial Sequence: Synthetic peptide
RCIN

SEQ ID NO: 790 - protein, 4 aa, Artificial Sequence
  Description of Artificial Sequence: Synthetic peptide
RRCR

SEQ ID NO: 791 - protein, 4 aa, Artificial Sequence
  Description of Artificial Sequence: Synthetic peptide
PCRR

SEQ ID NO: 792 - protein, 6 aa, Artificial Sequence
  Description of Artificial Sequence: Synthetic peptide
RRCSRR

SEQ ID NO: 793 - protein, 3 aa, Artificial Sequence
  Description of Artificial Sequence: Synthetic peptide
RQC

SEQ ID NO: 794 - protein, 4 aa, Artificial Sequence
  Description of Artificial Sequence: Synthetic peptide
PCKK

SEQ ID NO: 795 - protein, 6 aa, Artificial Sequence
  Description of Artificial Sequence: Synthetic peptide
KKCSKK

SEQ ID NO: 796 - protein, 8 aa, Artificial Sequence
  Description of Artificial Sequence: Synthetic peptide
GKCMNGKC

SEQ ID NO: 797 - protein, 8 aa, Artificial Sequence
  Description of Artificial Sequence: Synthetic peptide
GRCMNGRC

SEQ ID NO: 798 - protein, 32 aa, Artificial Sequence
  Description of Artificial Sequence: Synthetic polypeptide
GIVCKVCKIICGMQGKKVNICKAPIKCKCKKG

SEQ ID NO: 799 - protein, 35 aa, Artificial Sequence
  Description of Artificial Sequence: Synthetic polypeptide
SEKDCIKHLQRCRENKDCCSKKCSRRGTNPEKRCR

SEQ ID NO: 800 - protein, 37 aa, Artificial Sequence
  Description of Artificial Sequence: Synthetic polypeptide
VRIPVSCKHSGQCLKPCKDAGMRFGKCMNGKCDCTPK

SEQ ID NO: 801 - protein, 37 aa, Artificial Sequence
  Description of Artificial Sequence: Synthetic polypeptide
GVPINVKCRGSRDCLDPCKKAGMRFGKCINSKCHCTP

SEQ ID NO: 802 - protein, 33 aa, Artificial Sequence
  Description of Artificial Sequence: Synthetic polypeptide
AVCVYRTCDKDCKRRGYRSGKCINNACKCYPYG

SEQ ID NO: 803 - protein, 35 aa, Artificial Sequence
  Description of Artificial Sequence: Synthetic polypeptide
ISCTGSKQCYDPCKRKTGCPNAKCMNKSCKCYGCG

SEQ ID NO: 804 - protein, 38 aa, Artificial Sequence
  Description of Artificial Sequence: Synthetic polypeptide
QVQTNVKCQGGSCASVCRREIGVAAGKCINGKCVCYRN

SEQ ID NO: 805 - protein, 37 aa, Artificial Sequence
  Description of Artificial Sequence: Synthetic polypeptide
EVIRCSGSKQCYGPCKQQTGCTNSKCMNKVCKCYGCG

SEQ ID NO: 806 - protein, 33 aa, Artificial Sequence
  Description of Artificial Sequence: Synthetic polypeptide
ACKGVFDACTPGKNECCPNRVCSDKHKWCKWKL

SEQ ID NO: 807 - protein, 38 aa, Artificial Sequence
  Description of Artificial Sequence: Synthetic polypeptide
QIYTSKECNGSSECYSHCEGITGKRSGKCINKKCYCYR

SEQ ID NO: 808 - protein, 35 aa, Artificial Sequence
  Description of Artificial Sequence: Synthetic polypeptide
GCLEFWWKCNPNDDKCCRPKLKCSKLFKLCNFSFG

SEQ ID NO: 809 - protein, 37 aa, Artificial Sequence
  Description of Artificial Sequence: Synthetic polypeptide
DCVRFWGKCSQTSDCCPHLACKSKWPRNICVWDGSVG

SEQ ID NO: 810 - protein, 33 aa, Artificial Sequence
  Description of Artificial Sequence: Synthetic polypeptide
GCFGYKCDYYKGCCSGYVCSPTWKWCVRPGPGR

SEQ ID NO: 811 - protein, 60 aa, Artificial Sequence
  Description of Artificial Sequence: Synthetic polypeptide
MNAKFILLLVLTTMMLLPDTKGAEVIRCSGSKQCYGPCKQQTGCTNSKCMNKVCKCYGCG

SEQ ID NO: 812 - protein, 61 aa, Artificial Sequence
  Description of Artificial Sequence: Synthetic polypeptide
MNAKLIYLLLVVTTMTLMFDTAQAVDIMCSGPKQCYGPCKKETGCPNAKCMNRRCKCYGCV

SEQ ID NO: 813 - protein, 62 aa, Artificial Sequence
  Description of Artificial Sequence: Synthetic polypeptide
MNAKLIYLLLVVTTMMLTFDTTQAGDIKCSGTRQCWGPCKKQTTCTNSKCMNGKCKCYGCVG

SEQ ID NO: 814 - protein, 61 aa, Artificial Sequence
  Description of Artificial Sequence: Synthetic polypeptide
MNTKFIFLLLVVTNTMMLFDTKPVEGISCTGSKQCYDPCKRKTGCPNAKCMNKSCKCYGCG

SEQ ID NO: 815 - protein, 38 aa, Artificial Sequence
  Description of Artificial Sequence: Synthetic polypeptide
GVPINVKCSGSRDCLEPCKKAGMRFGKCINRKCHCTPK

SEQ ID NO: 816 - protein, 38 aa, Artificial Sequence
  Description of Artificial Sequence: Synthetic polypeptide
GVPINVKCTGSPQCLKPCKDAGMRFGKCINGKCHCTPK

SEQ ID NO: 817 - protein, 38 aa, Artificial Sequence
  Description of Artificial Sequence: Synthetic polypeptide
GVIINVKCKISRQCLEPCKKAGMRFGKCMNGKCHCTPK

SEQ ID NO: 818 - protein, 38 aa, Artificial Sequence
  Description of Artificial Sequence: Synthetic polypeptide
GVPINVKCRGSPQCIQPCRDAGMRFGKCMNGKCHCTPQ

SEQ ID NO: 819 - protein, 38 aa, Artificial Sequence
  Description of Artificial Sequence: Synthetic polypeptide
GVEINVKCTGSHQCIKPCKDAGMRFGKCINRKCHCTPK

SEQ ID NO: 820 - protein, 38 aa, Artificial Sequence
  Description of Artificial Sequence: Synthetic polypeptide
GVEINVKCSGSPQCLKPCKDAGMRFGKCMNRKCHCTPK

SEQ ID NO: 821 - protein, 38 aa, Artificial Sequence
  Description of Artificial Sequence: Synthetic polypeptide
GVPTDVKCRGSPQCIQPCKDAGMRFGKCMNGKCHCTPK

SEQ ID NO: 822 - protein, 38 aa, Artificial Sequence
  Description of Artificial Sequence: Synthetic polypeptide
GVPINVSCTGSPQCIKPCKDAGMRFGKCMNRKCHCTPK

SEQ ID NO: 823 - protein, 38 aa, Artificial Sequence
  Description of Artificial Sequence: Synthetic polypeptide
GVPINVPCTGSPQCIKPCKDAGMRFGKCMNRKCHCTPK

SEQ ID NO: 824 - protein, 37 aa, Artificial Sequence
  Description of Artificial Sequence: Synthetic polypeptide
VGINVKCKHSGQCLKPCKDAGMRFGKCINGKCDCTPK

SEQ ID NO: 825 - protein, 37 aa, Artificial Sequence
  Description of Artificial Sequence: Synthetic polypeptide
VGINVKCKHSGQCLKPCKDAGMRFGKCMNGKCDCTPK

SEQ ID NO: 826 - protein, 37 aa, Artificial Sequence
  Description of Artificial Sequence: Synthetic polypeptide
VGIPVSCKHSGQCIKPCKDAGMRFGKCMNRKCDCTPK

SEQ ID NO: 827 - protein, 36 aa, Artificial Sequence
  Description of Artificial Sequence: Synthetic polypeptide
RKGCFKEGHSCPKTAPCCRPLVCKGPSPNTKKCTRP

SEQ ID NO: 828 - protein, 32 aa, Artificial Sequence
  Description of Artificial Sequence: Synthetic polypeptide
SFCIPFKPCKSDENCCKKFKCKTTGIVKLCRW

SEQ ID NO: 829 - protein, 36 aa, Artificial Sequence
  Description of Artificial Sequence: Synthetic polypeptide
LKGCLPRNRFCNALSGPRCCSGLRCKELSIWASKCL

SEQ ID NO: 830 - protein, 34 aa, Artificial Sequence
  Description of Artificial Sequence: Synthetic polypeptide
GNYCLRGRCLPGGRKCCNGRPCECFAKICSCKPK

SEQ ID NO: 831 - protein, 29 aa, Artificial Sequence
  Description of Artificial Sequence: Synthetic peptide
TVKCGGCNRKCCPGGCRSGKCINGKCQCY

SEQ ID NO: 832 - protein, 29 aa, Artificial Sequence
  Description of Artificial Sequence: Synthetic peptide
GCMKEYCAGQCRGKVSQDYCLKHCKCIPR

SEQ ID NO: 833 - protein, 34 aa, Artificial Sequence
  Description of Artificial Sequence: Synthetic polypeptide
ACLGFGEKCNPSNDKCCKSSSLVCSQKHKWCKYG

SEQ ID NO: 834 - protein, 37 aa, Artificial Sequence
  Description of Artificial Sequence: Synthetic polypeptide
RGGCLPHNRFCNALSGPRCCSGLRCKELSIRDSRCLG

SEQ ID NO: 835 - protein, 36 aa, Artificial Sequence
  Description of Artificial Sequence: Synthetic polypeptide
RGGCLPRNKFCNPSSGPRCCSGLTCKELNIWASKCL

SEQ ID NO: 836 - protein, 33 aa, Artificial Sequence
  Description of Artificial Sequence: Synthetic polypeptide
QRSCAKPGDMCMGIKCCDGQCGCNRGTGRCFCK

SEQ ID NO: 837 - protein, 40 aa, Artificial Sequence
  Description of Artificial Sequence: Synthetic polypeptide
ARGCADAYKSCNHPRTCCDGYNGYKRACICSGSNCKCKKS

SEQ ID NO: 838 - protein, 37 aa, Artificial Sequence
  Description of Artificial Sequence: Synthetic polypeptide
RGGCLPHNRFCNALSGPRCCSGLRCKELSIWDSRCLG

SEQ ID NO: 839 - protein, 37 aa, Artificial Sequence
  Description of Artificial Sequence: Synthetic polypeptide
RGGCLPHNRFCNALSGPRCCSGLKCKELSIYDSRCLG

SEQ ID NO: 840 - protein, 37 aa, Artificial Sequence
  Description of Artificial Sequence: Synthetic polypeptide
RGGCLPHNRFCNALSGPRCCSRLKCKELSIWDSRCLG

SEQ ID NO: 841 - protein, 37 aa, Artificial Sequence
  Description of Artificial Sequence: Synthetic polypeptide
RGGCLPHNRFCNALTGPRCCSRLRCKELSIWDSICLG

SEQ ID NO: 842 - protein, 34 aa, Artificial Sequence
  Description of Artificial Sequence: Synthetic polypeptide
SCADAYKSCDSLKCCNNRTCMCSMIGTNCTCRKK

SEQ ID NO: 843 - protein, 30 aa, Artificial Sequence
  Description of Artificial Sequence: Synthetic polypeptide
ERRCLPAGKTCVRGPMRVPCCGSCSQNKCT

SEQ ID NO: 844 - protein, 31 aa, Artificial Sequence
  Description of Artificial Sequence: Synthetic polypeptide
LCSREGEFCYKLRKCCAGFYCKAFVLHCYRN

SEQ ID NO: 845 - protein, 23 aa, Artificial Sequence
  Description of Artificial Sequence: Synthetic peptide
ACGSCRKKCKGSGKCINGRCKCY

SEQ ID NO: 846 - protein, 23 aa, Artificial Sequence
  Description of Artificial Sequence: Synthetic peptide
ACGSCRKKCKGPGKCINGRCKCY

SEQ ID NO: 847 - protein, 32 aa, Artificial Sequence
  Description of Artificial Sequence: Synthetic polypeptide
ACQGYMRKCGRDKPPCCKKLECSKTWRWCVWN

SEQ ID NO: 848 - protein, 30 aa, Artificial Sequence
  Description of Artificial Sequence: Synthetic polypeptide
GRYCQKWMWTCDSKRACCEGLRCKLWCRKI

SEQ ID NO: 849 - protein, 34 aa, Artificial Sequence
  Description of Artificial Sequence: Synthetic polypeptide
NAKCRGSPECLPKCKEAIGKAAGKCMNGKCKCYP

SEQ ID NO: 850 - protein, 34 aa, Artificial Sequence
  Description of Artificial Sequence: Synthetic polypeptide
NVKCRGSKECLPACKAAVGKAAGKCMNGKCKCYP

SEQ ID NO: 851 - protein, 34 aa, Artificial Sequence
  Description of Artificial Sequence: Synthetic polypeptide
NVKCRGSPECLPKCKEAIGKSAGKCMNGKCKCYP

SEQ ID NO: 852 - protein, 34 aa, Artificial Sequence
  Description of Artificial Sequence: Synthetic polypeptide
NAKCRGSPECLPKCKQAIGKAAGKCMNGKCKCYP

SEQ ID NO: 853 - protein, 33 aa, Artificial Sequence
  Description of Artificial Sequence: Synthetic polypeptide
RGYCAEKGIKCHNIHCCSGLTCKCKGSSCVCRK

SEQ ID NO: 854 - protein, 31 aa, Artificial Sequence
  Description of Artificial Sequence: Synthetic polypeptide
ERGCKLTFWKCKNKKECCGWNACALGICMPR

SEQ ID NO: 855 - protein, 39 aa, Artificial Sequence
  Description of Artificial Sequence: Synthetic polypeptide
KKKCIAKDYGRCKWGGTPCCRGRGCICSIMGTNCECKPR

SEQ ID NO: 856 - protein, 29 aa, Artificial Sequence
  Description of Artificial Sequence: Synthetic peptide
GCKLTFWKCKNKKECCGWNACALGICMPR

SEQ ID NO: 857 - protein, 32 aa, Artificial Sequence
  Description of Artificial Sequence: Synthetic polypeptide
ACKGLFVTCTPGKDECCPNHVCSSKHKWCKYK

SEQ ID NO: 858 - protein, 36 aa, Artificial Sequence
  Description of Artificial Sequence: Synthetic polypeptide
IACAPRGLLCFRDKECCKGLTCKGRFVNTWPTFCLV

SEQ ID NO: 859 - protein, 36 aa, Artificial Sequence
  Description of Artificial Sequence: Synthetic polypeptide
ACAGLYKKCGKGVNTCCENRPCKCDLAMGNCICKKK

SEQ ID NO: 860 - protein, 38 aa, Artificial Sequence
  Description of Artificial Sequence: Synthetic polypeptide
FTCAISCDIKVNGKPCKGSGEKKCSGGWSCKFNVCVKV

SEQ ID NO: 861 - protein, 33 aa, Artificial Sequence
  Description of Artificial Sequence: Synthetic polypeptide
GFCAQKGIKCHDIHCCTNLKCVREGSNRVCRKA

SEQ ID NO: 862 - protein, 42 aa, Artificial Sequence
  Description of Artificial Sequence: Synthetic polypeptide
CAKKRNWCGKNEDCCCPMKCIYAWYNQQGSCQSTITGLFKKC

SEQ ID NO: 863 - protein, 28 aa, Artificial Sequence
  Description of Artificial Sequence: Synthetic peptide
YCQKWMWTCDSARKCCEGLVCRLWCKKI

SEQ ID NO: 864 - protein, 37 aa, Artificial Sequence
  Description of Artificial Sequence: Synthetic polypeptide
RGGCLPHNKFCNALSGPRCCSGLKCKELTIWNTKCLE

SEQ ID NO: 865 - protein, 34 aa, Artificial Sequence
  Description of Artificial Sequence: Synthetic polypeptide
NVKCTGSKQCLPACKAAVGKAAGKCMNGKCKCYT

SEQ ID NO: 866 - protein, 33 aa, Artificial Sequence
  Description of Artificial Sequence: Synthetic polypeptide
QRSCAKPGEMCMRIKCCDGQCGCNRGTGRCFCK

SEQ ID NO: 867 - protein, 36 aa, Artificial Sequence
  Description of Artificial Sequence: Synthetic polypeptide
GCIPKHKRCTWSGPKCCNNISCHCNISGTLCKCRPG

SEQ ID NO: 868 - protein, 33 aa, Artificial Sequence
  Description of Artificial Sequence: Synthetic polypeptide
NYCVAKRCRPGGRQCCSGKPCACVGKVCKCPRD

SEQ ID NO: 869 - protein, 37 aa, Artificial Sequence
  Description of Artificial Sequence: Synthetic polypeptide
ERGCSGAYKRCSSSQRCCEGRPCVCSAINSNCKCRKT

SEQ ID NO: 870 - protein, 36 aa, Artificial Sequence
  Description of Artificial Sequence: Synthetic polypeptide
RYCPRNPEACYNYCLRTGRPGGYCGGRSRITCFCFR

SEQ ID NO: 871 - protein, 33 aa, Artificial Sequence
  Description of Artificial Sequence: Synthetic polypeptide
QRSCAKPGEMCMGIKCCDGQCGCNRGTGRCFCK

SEQ ID NO: 872 - protein, 36 aa, Artificial Sequence
  Description of Artificial Sequence: Synthetic polypeptide
RRGCFKEGKWCPKSAPCCAPLKCKGPSIKQQKCVRE

SEQ ID NO: 873 - protein, 31 aa, Artificial Sequence
  Description of Artificial Sequence: Synthetic polypeptide
TVKCGGCNRKCCAGGCRSGKCINGKCQCYGR

SEQ ID NO: 874 - protein, 29 aa, Artificial Sequence
  Description of Artificial Sequence: Synthetic peptide
ERRCEPSGKPCRPLMRIPCCGSCVRGKCA

SEQ ID NO: 875 - protein, 36 aa, Artificial Sequence
  Description of Artificial Sequence: Synthetic polypeptide
RGGCLPRNKFCNPSSGPRCCSGLTCKELNIWANKCL

SEQ ID NO: 876 - protein, 42 aa, Artificial Sequence
  Description of Artificial Sequence: Synthetic polypeptide
CAKKRNWCGKNEDCCCPMKCIYAWYNQQGSCQTTITGLFKKC

SEQ ID NO: 877 - protein, 37 aa, Artificial Sequence
  Description of Artificial Sequence: Synthetic polypeptide
VRIPVSCKHSGQCLKPCKDAGMRTGKCMNGKCDCTPK

SEQ ID NO: 878 - protein, 20 aa, Artificial Sequence
  Description of Artificial Sequence: Synthetic peptide
VKCTTSKDCWPPCKKVTGRA

SEQ ID NO: 879 - protein, 32 aa, Artificial Sequence
  Description of Artificial Sequence: Synthetic polypeptide
GIVCRVCRIICGMQGRRVNICRAPIRCRCRRG

SEQ ID NO: 880 - protein, 35 aa, Artificial Sequence
  Description of Artificial Sequence: Synthetic polypeptide
SERDCIRHLQRCRENRDCCSRRCSRRGTNPERRCR

SEQ ID NO: 881 - protein, 37 aa, Artificial Sequence
  Description of Artificial Sequence: Synthetic polypeptide
VRIPVSCRHSGQCLRPCRDAGMRFGRCMNGRCDCTPR

SEQ ID NO: 882 - protein, 37 aa, Artificial Sequence
  Description of Artificial Sequence: Synthetic polypeptide
GVPINVRCRGSRDCLDPCRRAGMRFGRCINSRCHCTP

SEQ ID NO: 883 - protein, 33 aa, Artificial Sequence
  Description of Artificial Sequence: Synthetic polypeptide
AVCVYRTCDRDCRRRGYRSGRCINNACRCYPYG

SEQ ID NO: 884 - protein, 35 aa, Artificial Sequence
  Description of Artificial Sequence: Synthetic polypeptide
ISCTGSRQCYDPCRRRTGCPNARCMNRSCRCYGCG

SEQ ID NO: 885 - protein, 38 aa, Artificial Sequence
  Description of Artificial Sequence: Synthetic polypeptide
QVQTNVRCQGGSCASVCRREIGVAAGRCINGRCVCYRN

SEQ ID NO: 886 - protein, 37 aa, Artificial Sequence
  Description of Artificial Sequence: Synthetic polypeptide
EVIRCSGSRQCYGPCRQQTGCTNSRCMNRVCRCYGCG

SEQ ID NO: 887 - protein, 33 aa, Artificial Sequence
  Description of Artificial Sequence: Synthetic polypeptide
ACRGVFDACTPGRNECCPNRVCSDRHRWCRWRL

SEQ ID NO: 888 - protein, 38 aa, Artificial Sequence
  Description of Artificial Sequence: Synthetic polypeptide
QIYTSRECNGSSECYSHCEGITGRRSGRCINRRCYCYR

SEQ ID NO: 889 - protein, 35 aa, Artificial Sequence
  Description of Artificial Sequence: Synthetic polypeptide
GCLEFWWRCNPNDDRCCRPRLRCSRLFRLCNFSFG

SEQ ID NO: 890 - protein, 37 aa, Artificial Sequence
  Description of Artificial Sequence: Synthetic polypeptide
DCVRFWGRCSQTSDCCPHLACRSRWPRNICVWDGSVG

SEQ ID NO: 891 - protein, 33 aa, Artificial Sequence
  Description of Artificial Sequence: Synthetic polypeptide
GCFGYRCDYYRGCCSGYVCSPTWRWCVRPGPGR

SEQ ID NO: 892 - protein, 60 aa, Artificial Sequence
  Description of Artificial Sequence: Synthetic polypeptide
MNARFILLLVLTTMMLLPDTRGAEVIRCSGSRQCYGPCRQQTGCTNSRCMNRVCRCYGCG

SEQ ID NO: 893 - protein, 61 aa, Artificial Sequence
  Description of Artificial Sequence: Synthetic polypeptide
MNARLIYLLLVVTTMTLMFDTAQAVDIMCSGPRQCYGPCRRETGCPNARCMNRRCRCYGCV

SEQ ID NO: 894 - protein, 62 aa, Artificial Sequence
  Description of Artificial Sequence: Synthetic polypeptide
MNARLIYLLLVVTTMMLTFDTTQAGDIRCSGTRQCWGPCRRQTTCTNSRCMNGRCRCYGCVG

SEQ ID NO: 895 - protein, 61 aa, Artificial Sequence
  Description of Artificial Sequence: Synthetic polypeptide
MNTRFIFLLLVVTNTMMLFDTRPVEGISCTGSRQCYDPCRRRTGCPNARCMNRSCRCYGCG

SEQ ID NO: 896 - protein, 38 aa, Artificial Sequence
  Description of Artificial Sequence: Synthetic polypeptide
GVPINVRCSGSRDCLEPCRRAGMRFGRCINRRCHCTPR

SEQ ID NO: 897 - protein, 38 aa, Artificial Sequence
  Description of Artificial Sequence: Synthetic polypeptide
GVPINVRCTGSPQCLRPCRDAGMRFGRCINGRCHCTPR

SEQ ID NO: 898 - protein, 38 aa, Artificial Sequence
  Description of Artificial Sequence: Synthetic polypeptide
GVIINVRCRISRQCLEPCRRAGMRFGRCMNGRCHCTPR

SEQ ID NO: 899 - protein, 38 aa, Artificial Sequence
  Description of Artificial Sequence: Synthetic polypeptide
GVPINVRCRGSPQCIQPCRDAGMRFGRCMNGRCHCTPQ

SEQ ID NO: 900 - protein, 38 aa, Artificial Sequence
  Description of Artificial Sequence: Synthetic polypeptide
GVEINVRCTGSHQCIRPCRDAGMRFGRCINRRCHCTPR

SEQ ID NO: 901 - protein, 38 aa, Artificial Sequence
  Description of Artificial Sequence: Synthetic polypeptide
GVEINVRCSGSPQCLRPCRDAGMRFGRCMNRRCHCTPR

SEQ ID NO: 902 - protein, 38 aa, Artificial Sequence
  Description of Artificial Sequence: Synthetic polypeptide
GVPTDVRCRGSPQCIQPCRDAGMRFGRCMNGRCHCTPR

SEQ ID NO: 903 - protein, 38 aa, Artificial Sequence
  Description of Artificial Sequence: Synthetic polypeptide
GVPINVSCTGSPQCIRPCRDAGMRFGRCMNRRCHCTPR

SEQ ID NO: 904 - protein, 38 aa, Artificial Sequence
  Description of Artificial Sequence: Synthetic polypeptide
GVPINVPCTGSPQCIRPCRDAGMRFGRCMNRRCHCTPR

SEQ ID NO: 905 - protein, 37 aa, Artificial Sequence
  Description of Artificial Sequence: Synthetic polypeptide
VGINVRCRHSGQCLRPCRDAGMRFGRCINGRCDCTPR

SEQ ID NO: 906 - protein, 37 aa, Artificial Sequence
  Description of Artificial Sequence: Synthetic polypeptide
VGINVRCRHSGQCLRPCRDAGMRFGRCMNGRCDCTPR

SEQ ID NO: 907 - protein, 37 aa, Artificial Sequence
  Description of Artificial Sequence: Synthetic polypeptide
VGIPVSCRHSGQCIRPCRDAGMRFGRCMNRRCDCTPR

SEQ ID NO: 908 - protein, 36 aa, Artificial Sequence
  Description of Artificial Sequence: Synthetic polypeptide
RRGCFREGHSCPRTAPCCRPLVCRGPSPNTRRCTRP

SEQ ID NO: 909 - protein, 32 aa, Artificial Sequence
  Description of Artificial Sequence: Synthetic polypeptide
SFCIPFRPCRSDENCCRRFRCRTTGIVRLCRW

SEQ ID NO: 910 - protein, 36 aa, Artificial Sequence
  Description of Artificial Sequence: Synthetic polypeptide
LRGCLPRNRFCNALSGPRCCSGLRCRELSIWASRCL

SEQ ID NO: 911 - protein, 34 aa, Artificial Sequence
  Description of Artificial Sequence: Synthetic polypeptide
GNYCLRGRCLPGGRRCCNGRPCECFARICSCRPR

SEQ ID NO: 912 - protein, 29 aa, Artificial Sequence
  Description of Artificial Sequence: Synthetic peptide
TVRCGGCNRRCCPGGCRSGRCINGRCQCY

SEQ ID NO: 913 - protein, 29 aa, Artificial Sequence
  Description of Artificial Sequence: Synthetic peptide
GCMREYCAGQCRGRVSQDYCLRHCRCIPR

SEQ ID NO: 914 - protein, 34 aa, Artificial Sequence
  Description of Artificial Sequence: Synthetic polypeptide
ACLGFGERCNPSNDRCCRSSSLVCSQRHRWCRYG

SEQ ID NO: 915 - protein, 37 aa, Artificial Sequence
  Description of Artificial Sequence: Synthetic polypeptide
RGGCLPHNRFCNALSGPRCCSGLRCRELSIRDSRCLG

SEQ ID NO: 916 - protein, 36 aa, Artificial Sequence
  Description of Artificial Sequence: Synthetic polypeptide
RGGCLPRNRFCNPSSGPRCCSGLTCRELNIWASRCL

SEQ ID NO: 917 - protein, 33 aa, Artificial Sequence
  Description of Artificial Sequence: Synthetic polypeptide
QRSCARPGDMCMGIRCCDGQCGCNRGTGRCFCR

SEQ ID NO: 918 - protein, 40 aa, Artificial Sequence
  Description of Artificial Sequence: Synthetic polypeptide
ARGCADAYRSCNHPRTCCDGYNGYRRACICSGSNCRCRRS

SEQ ID NO: 919 - protein, 37 aa, Artificial Sequence
  Description of Artificial Sequence: Synthetic polypeptide
RGGCLPHNRFCNALSGPRCCSGLRCRELSIWDSRCLG

SEQ ID NO: 920 - protein, 37 aa, Artificial Sequence
  Description of Artificial Sequence: Synthetic polypeptide
RGGCLPHNRFCNALSGPRCCSGLRCRELSIYDSRCLG

SEQ ID NO: 921 - protein, 37 aa, Artificial Sequence
  Description of Artificial Sequence: Synthetic polypeptide
RGGCLPHNRFCNALSGPRCCSRLRCRELSIWDSRCLG

SEQ ID NO: 922 - protein, 37 aa, Artificial Sequence
  Description of Artificial Sequence: Synthetic polypeptide
RGGCLPHNRFCNALTGPRCCSRLRCRELSIWDSICLG

SEQ ID NO: 923 - protein, 34 aa, Artificial Sequence
  Description of Artificial Sequence: Synthetic polypeptide
SCADAYKSCDSLRCCNNRTCMCSMIGTNCTCRRR

SEQ ID NO: 924 - protein, 30 aa, Artificial Sequence
  Description of Artificial Sequence: Synthetic polypeptide
ERRCLPAGRTCVRGPMRVPCCGSCSQNRCT

SEQ ID NO: 925 - protein, 31 aa, Artificial Sequence
  Description of Artificial Sequence: Synthetic polypeptide
LCSREGEFCYRLRRCCAGFYCRAFVLHCYRN

SEQ ID NO: 926 - protein, 23 aa, Artificial Sequence
  Description of Artificial Sequence: Synthetic peptide
ACGSCRRRCRGSGRCINGRCRCY

SEQ ID NO: 927 - protein, 23 aa, Artificial Sequence
  Description of Artificial Sequence: Synthetic peptide
ACGSCRRRCRGPGRCINGRCRCY

SEQ ID NO: 928 - protein, 32 aa, Artificial Sequence
  Description of Artificial Sequence: Synthetic polypeptide
ACQGYMRRCGRDRPPCCRRLECSRTWRWCVWN

SEQ ID NO: 929 - protein, 30 aa, Artificial Sequence
  Description of Artificial Sequence: Synthetic polypeptide
GRYCQRWMWTCDSRRACCEGLRCRLWCRRI

SEQ ID NO: 930 - protein, 34 aa, Artificial Sequence
  Description of Artificial Sequence: Synthetic polypeptide
NARCRGSPECLPRCREAIGRAAGRCMNGRCRCYP

SEQ ID NO: 931 - protein, 34 aa, Artificial Sequence
  Description of Artificial Sequence: Synthetic polypeptide
NVRCRGSRECLPACRAAVGRAAGRCMNGRCRCYP

SEQ ID NO: 932 - protein, 34 aa, Artificial Sequence
  Description of Artificial Sequence: Synthetic polypeptide
NVRCRGSPECLPRCREAIGRSAGRCMNGRCRCYP

SEQ ID NO: 933 - protein, 34 aa, Artificial Sequence
  Description of Artificial Sequence: Synthetic polypeptide
NARCRGSPECLPRCRQAIGRAAGRCMNGRCRCYP

SEQ ID NO: 934 - protein, 33 aa, Artificial Sequence
  Description of Artificial Sequence: Synthetic polypeptide
RGYCAERGIRCHNIHCCSGLTCRCRGSSCVCRR

SEQ ID NO: 935 - protein, 31 aa, Artificial Sequence
  Description of Artificial Sequence: Synthetic polypeptide
ERGCRLTFWRCRNRRECCGWNACALGICMPR

SEQ ID NO: 936 - protein, 39 aa, Artificial Sequence
  Description of Artificial Sequence: Synthetic polypeptide
RRRCIARDYGRCRWGGTPCCRGRGCICSIMGTNCECRPR

SEQ ID NO: 937 - protein, 29 aa, Artificial Sequence
  Description of Artificial Sequence: Synthetic peptide
GCRLTFWRCRNRRECCGWNACALGICMPR

SEQ ID NO: 938 - protein, 32 aa, Artificial Sequence
  Description of Artificial Sequence: Synthetic polypeptide
ACRGLFVTCTPGRDECCPNHVCSSRHRWCRYR

SEQ ID NO: 939 - protein, 36 aa, Artificial Sequence
  Description of Artificial Sequence: Synthetic polypeptide
IACAPRGLLCFRDRECCRGLTCRGRFVNTWPTFCLV

SEQ ID NO: 940 - protein, 36 aa, Artificial Sequence
  Description of Artificial Sequence: Synthetic polypeptide
ACAGLYRRCGRGVNTCCENRPCRCDLAMGNCICRRR

SEQ ID NO: 941 - protein, 38 aa, Artificial Sequence
  Description of Artificial Sequence: Synthetic polypeptide
FTCAISCDIRVNGRPCRGSGERRCSGGWSCRFNVCVRV

SEQ ID NO: 942 - protein, 33 aa, Artificial Sequence
  Description of Artificial Sequence: Synthetic polypeptide
GFCAQRGIRCHDIHCCTNLRCVREGSNRVCRRA

SEQ ID NO: 943 - protein, 42 aa, Artificial Sequence
  Description of Artificial Sequence: Synthetic polypeptide
CARRRNWCGRNEDCCCPMRCIYAWYNQQGSCQSTITGLFRRC

SEQ ID NO: 944 - protein, 28 aa, Artificial Sequence
  Description of Artificial Sequence: Synthetic peptide
YCQRWMWTCDSARRCCEGLVCRLWCRRI

SEQ ID NO: 945 - protein, 37 aa, Artificial Sequence
  Description of Artificial Sequence: Synthetic polypeptide
RGGCLPHNRFCNALSGPRCCSGLRCRELTIWNTRCLE

SEQ ID NO: 946 - protein, 34 aa, Artificial Sequence
  Description of Artificial Sequence: Synthetic polypeptide
NVRCTGSRQCLPACRAAVGRAAGRCMNGRCRCYT

SEQ ID NO: 947 - protein, 33 aa, Artificial Sequence
  Description of Artificial Sequence: Synthetic polypeptide
QRSCARPGEMCMRIRCCDGQCGCNRGTGRCFCR

SEQ ID NO: 948 - protein, 36 aa, Artificial Sequence
  Description of Artificial Sequence: Synthetic polypeptide
GCIPRHRRCTWSGPRCCNNISCHCNISGTLCRCRPG

SEQ ID NO: 949 - protein, 33 aa, Artificial Sequence
  Description of Artificial Sequence: Synthetic polypeptide
NYCVARRCRPGGRQCCSGRPCACVGRVCRCPRD

SEQ ID NO: 950 - protein, 37 aa, Artificial Sequence
  Description of Artificial Sequence: Synthetic polypeptide
ERGCSGAYRRCSSSQRCCEGRPCVCSAINSNCRCRRT

SEQ ID NO: 951 - protein, 33 aa, Artificial Sequence
  Description of Artificial Sequence: Synthetic polypeptide
QRSCARPGEMCMGIRCCDGQCGCNRGTGRCFCR

SEQ ID NO: 952 - protein, 36 aa, Artificial Sequence
  Description of Artificial Sequence: Synthetic polypeptide
RRGCFREGRWCPRSAPCCAPLRCRGPSIRQQRCVRE

SEQ ID NO: 953 - protein, 31 aa, Artificial Sequence
  Description of Artificial Sequence: Synthetic polypeptide
TVRCGGCNRRCCAGGCRSGRCINGRCQCYGR

SEQ ID NO: 954 - protein, 29 aa, Artificial Sequence
  Description of Artificial Sequence: Synthetic peptide
ERRCEPSGRPCRPLMRIPCCGSCVRGRCA

SEQ ID NO: 955 - protein, 36 aa, Artificial Sequence
  Description of Artificial Sequence: Synthetic polypeptide
RGGCLPRNRFCNPSSGPRCCSGLTCRELNIWANRCL

SEQ ID NO: 956 - protein, 42 aa, Artificial Sequence
  Description of Artificial Sequence: Synthetic polypeptide
CARRRNWCGRNEDCCCPMRCIYAWYNQQGSCQTTITGLFRRC

SEQ ID NO: 957 - protein, 37 aa, Artificial Sequence
  Description of Artificial Sequence: Synthetic polypeptide
VRIPVSCRHSGQCLRPCRDAGMRTGRCMNGRCDCTPR

SEQ ID NO: 958 - protein, 38 aa, Artificial Sequence
  Description of Artificial Sequence: Synthetic polypeptide
QKILSNRCNNSSECIPHCIRIFGTRAAKCINRKCYCYP

SEQ ID NO: 959 - protein, 32 aa, Artificial Sequence
  Description of Artificial Sequence: Synthetic polypeptide
AVCNLKRCQLSCRSLGLLGKCIGDKCECVKHG

SEQ ID NO: 960 - protein, 37 aa, Artificial Sequence
  Description of Artificial Sequence: Synthetic polypeptide
ISIGIRCSPSIDLCEGQCRIRRYFTGYCSGDTCHCSG

SEQ ID NO: 961 - protein, 33 aa, Artificial Sequence
  Description of Artificial Sequence: Synthetic polypeptide
GDCLPHLRRCRENNDCCSRRCRRRGANPERRCR

SEQ ID NO: 962 - protein, 34 aa, Artificial Sequence
  Description of Artificial Sequence: Synthetic polypeptide
SCEPGRTFRDRCNTCKCGADGRSAACTLRACPNQ

SEQ ID NO: 963 - protein, 33 aa, Artificial Sequence
  Description of Artificial Sequence: Synthetic polypeptide
GDCLPHLKRCKADNDCCGKKCKRRGTNAEKRCR

SEQ ID NO: 964 - protein, 33 aa, Artificial Sequence
  Description of Artificial Sequence: Synthetic polypeptide
GDCLPHLKRCKENNDCCSKKCKRRGTNPEKRCR

SEQ ID NO: 965 - protein, 33 aa, Artificial Sequence
  Description of Artificial Sequence: Synthetic polypeptide
KDCLKKLKLCKENKDCCSKSCKRRGTNIEKRCR

SEQ ID NO: 966 - protein, 33 aa, Artificial Sequence
  Description of Artificial Sequence: Synthetic polypeptide
GDCLPHLKRCKENNDCCSKKCKRRGANPEKRCR

SEQ ID NO: 967 - protein, 37 aa, Artificial Sequence
  Description of Artificial Sequence: Synthetic polypeptide
VFINVKCRGSPECLPKCKEAIGKSAGKCMNGKCKCYP

SEQ ID NO: 968 - protein, 37 aa, Artificial Sequence
  Description of Artificial Sequence: Synthetic polypeptide
VFINAKCRGSPECLPKCKEAIGKAAGKCMNGKCKCYP

SEQ ID NO: 969 - protein, 36 aa, Artificial Sequence
  Description of Artificial Sequence: Synthetic polypeptide
VIINVKCKISRQCLEPCKKAGMRFGKCMNGKCHCTP

SEQ ID NO: 970 - protein, 36 aa, Artificial Sequence
  Description of Artificial Sequence: Synthetic polypeptide
VPTDVKCRGSPQCIQPCKDAGMRFGKCMNGKCHCTP

SEQ ID NO: 971 - protein, 36 aa, Artificial Sequence
  Description of Artificial Sequence: Synthetic polypeptide
VRIPVSCKHSGQCLKPCKDAGMRFGKCMNGKCDCTP

SEQ ID NO: 972 - protein, 36 aa, Artificial Sequence
  Description of Artificial Sequence: Synthetic polypeptide
VRIPVSCRHSGQCLRPCRDAGMRFGRCMNGRCDCTP

SEQ ID NO: 973 - protein, 33 aa, Artificial Sequence
  Description of Artificial Sequence: Synthetic polypeptide
TNVSCTTSKECWSVCQRLHNTSRGKCMNKKCRC

SEQ ID NO: 974 - protein, 32 aa, Artificial Sequence
  Description of Artificial Sequence: Synthetic polypeptide
NVKCTGSKQCLPACKAAVGKAAGKCMNGKCKC

SEQ ID NO: 975 - protein, 37 aa, Artificial Sequence
  Description of Artificial Sequence: Synthetic polypeptide
GVPINVRCRGSRDCLDPCRGAGERHGRCGNSRCHCTP

SEQ ID NO: 976 - protein, 37 aa, Artificial Sequence
  Description of Artificial Sequence: Synthetic polypeptide
VRIPVSCRHSGQCLRPCRDAGERHGRCGGGRCDCTPR

SEQ ID NO: 977 - protein, 38 aa, Artificial Sequence
  Description of Artificial Sequence: Synthetic polypeptide
QVQTNVRCQGGSCGSVCRREGGGAGGGCGNGRCGCYRN

SEQ ID NO: 978 - protein, 32 aa, Artificial Sequence
  Description of Artificial Sequence: Synthetic polypeptide
IKCSESYQCFPVCKSRFGKTNGRCVNGFCDCF

SEQ ID NO: 979 - protein, 33 aa, Artificial Sequence
  Description of Artificial Sequence: Synthetic polypeptide
VKCSSPQQCLKPCKAAFGISAGGKCINGKCKCY

SEQ ID NO: 980 - protein, 32 aa, Artificial Sequence
  Description of Artificial Sequence: Synthetic polypeptide
VSCSASSQCWPVCKKLFGTYRGKCMNSKCRCY

SEQ ID NO: 981 - protein, 32 aa, Artificial Sequence
  Description of Artificial Sequence: Synthetic polypeptide
ESCTASNQCWSICKRLHNTNRGKCMNKKCRCY

SEQ ID NO: 982 - protein, 32 aa, Artificial Sequence
  Description of Artificial Sequence: Synthetic polypeptide
VSCTTSKECWSVCEKLYNTSRGKCMNKKCRCY

SEQ ID NO: 983 - protein, 32 aa, Artificial Sequence
  Description of Artificial Sequence: Synthetic polypeptide
MRCKSSKECLVKCKQATGRPNGKCMNRKCKCY

SEQ ID NO: 984 - protein, 32 aa, Artificial Sequence
  Description of Artificial Sequence: Synthetic polypeptide
IKCTLSKDCYSPCKKETGCPRAKCINRNCKCY

SEQ ID NO: 985 - protein, 32 aa, Artificial Sequence
  Description of Artificial Sequence: Synthetic polypeptide
IRCSGSRDCYSPCMKQTGCPNAKCINKSCKCY

SEQ ID NO: 986 - protein, 32 aa, Artificial Sequence
  Description of Artificial Sequence: Synthetic polypeptide
IRCSGTRECYAPCQKLTGCLNAKCMNKACKCY

SEQ ID NO: 987 - protein, 32 aa, Artificial Sequence
  Description of Artificial Sequence: Synthetic polypeptide
ISCTNPKQCYPHCKKETGYPNAKCMNRKCKCF

SEQ ID NO: 988 - protein, 32 aa, Artificial Sequence
  Description of Artificial Sequence: Synthetic polypeptide
ASCRTPKDCADPCRKETGCPYGKCMNRKCKCN

SEQ ID NO: 989 - protein, 31 aa, Artificial Sequence
  Description of Artificial Sequence: Synthetic polypeptide
TSCISPKQCTEPCRAKGCKHGKCMNRKCHCM

SEQ ID NO: 990 - protein, 31 aa, Artificial Sequence
  Description of Artificial Sequence: Synthetic polypeptide
KECTGPQHCTNFCRKNKCTHGKCMNRKCKCF

SEQ ID NO: 991 - protein, 32 aa, Artificial Sequence
  Description of Artificial Sequence: Synthetic polypeptide
IKCRTPKDCADPCRKQTGCPHAKCMNKTCRCH

SEQ ID NO: 992 - protein, 32 aa, Artificial Sequence
  Description of Artificial Sequence: Synthetic polypeptide
VKCTTSKECWPPCKAATGKAAGKCMNKKCKCQ

SEQ ID NO: 993 - protein, 32 aa, Artificial Sequence
  Description of Artificial Sequence: Synthetic polypeptide
LECGASRECYDPCFKAFGRAHGKCMNNKCRCY

SEQ ID NO: 994 - protein, 32 aa, Artificial Sequence
  Description of Artificial Sequence: Synthetic polypeptide
EKCFATSQCWTPCKKAIGSLQSKCMNGKCKCY

SEQ ID NO: 995 - protein, 32 aa, Artificial Sequence
  Description of Artificial Sequence: Synthetic polypeptide
VRCYASRECWEPCRRVTGSAQAKCQNNQCRCY

SEQ ID NO: 996 - protein, 32 aa, Artificial Sequence
  Description of Artificial Sequence: Synthetic polypeptide
VKCSASRECWVACKKVTGSGQGKCQNNQCRCY

SEQ ID NO: 997 - protein, 32 aa, Artificial Sequence
  Description of Artificial Sequence: Synthetic polypeptide
VKCISSQECWIACKKVTGRFEGKCQNRQCRCY

SEQ ID NO: 998 - protein, 32 aa, Artificial Sequence
  Description of Artificial Sequence: Synthetic polypeptide
VRCYDSRQCWIACKKVTGSTQGKCQNKQCRCY

SEQ ID NO: 999 - protein, 32 aa, Artificial Sequence
  Description of Artificial Sequence: Synthetic polypeptide
VDCTVSKECWAPCKAAFGVDRGKCMGKKCKCY

SEQ ID NO: 1000 - protein, 32 aa, Artificial Sequence
  Description of Artificial Sequence: Synthetic polypeptide
AKCRGSPECLPKCKEAIGKAAGKCMNGKCKCY

SEQ ID NO: 1001 - protein, 31 aa, Artificial Sequence
  Description of Artificial Sequence: Synthetic polypeptide
KKCQGGSCASVCRRVIGVAAGKCINGRCVCY

SEQ ID NO: 1002 - protein, 32 aa, Artificial Sequence
  Description of Artificial Sequence: Synthetic polypeptide
KKCSNTSQCYKTCEKVVGVAAGKCMNGKCICY

SEQ ID NO: 1003 - protein, 32 aa, Artificial Sequence
  Description of Artificial Sequence: Synthetic polypeptide
VKCSGSSKCVKICIDRYNTRGAKCINGRCTCY

SEQ ID NO: 1004 - protein, 32 aa, Artificial Sequence
  Description of Artificial Sequence: Synthetic polypeptide
NRCNNSSECIPHCIRIFGTRAAKCINRKCYCY

SEQ ID NO: 1005 - protein, 32 aa, Artificial Sequence
  Description of Artificial Sequence: Synthetic polypeptide
KECNGSSECYSHCEGITGKRSGKCINKKCYCY

SEQ ID NO: 1006 - protein, 29 aa, Artificial Sequence
  Description of Artificial Sequence: Synthetic peptide
AFCNLRRCELSCRSLGLLGKCIGEECKCV

SEQ ID NO: 1007 - protein, 29 aa, Artificial Sequence
  Description of Artificial Sequence: Synthetic peptide
AVCNLKRCQLSCRSLGLLGKCIGDKCECV

SEQ ID NO: 1008 - protein, 30 aa, Artificial Sequence
  Description of Artificial Sequence: Synthetic polypeptide
AACYSSDCRVKCVAMGFSSGKCINSKCKCY

SEQ ID NO: 1009 - protein, 27 aa, Artificial Sequence
  Description of Artificial Sequence: Synthetic peptide
AICATDADCSRKCPGNPPCRNGFCACT

SEQ ID NO: 1010 - protein, 27 aa, Artificial Sequence
  Description of Artificial Sequence: Synthetic peptide
TECQIKNDCQRYCQSVKECKYGKCYCN

SEQ ID NO: 1011 - protein, 27 aa, Artificial Sequence
  Description of Artificial Sequence: Synthetic peptide
TQCQSVRDCQQYCLTPDRCSYGTCYCK

SEQ ID NO: 1012 - protein, 32 aa, Artificial Sequence
  Description of Artificial Sequence: Synthetic polypeptide
VSCRYGSDCAEPCKRLKCLLPSKCINGKCTCY

SEQ ID NO: 1013 - protein, 32 aa, Artificial Sequence
  Description of Artificial Sequence: Synthetic polypeptide
IKCRYPADCHIMCRKVTGRAEGKCMNGKCTCY

SEQ ID NO: 1014 - protein, 32 aa, Artificial Sequence
  Description of Artificial Sequence: Synthetic polypeptide
IKCSSSSSCYEPCRGVTGRAHGKCMNGRCTCY

SEQ ID NO: 1015 - protein, 32 aa, Artificial Sequence
  Description of Artificial Sequence: Synthetic polypeptide
VKCTGSKQCLPACKAAVGKAAGKCMNGKCKCY

SEQ ID NO: 1016 - protein, 31 aa, Artificial Sequence
  Description of Artificial Sequence: Synthetic polypeptide
VSCKHSGQCIKPCKDAGMRFGKCMNRKCDCT

SEQ ID NO: 1017 - protein, 31 aa, Artificial Sequence
  Description of Artificial Sequence: Synthetic polypeptide
VKCRGSPQCIQPCRDAGMRFGKCMNGKCHCT

SEQ ID NO: 1018 - protein, 33 aa, Artificial Sequence
  Description of Artificial Sequence: Synthetic polypeptide
VKCTSPKQCLPPCKAQFGIRAGAKCMNGKCKCY

SEQ ID NO: 1019 - protein, 33 aa, Artificial Sequence
  Description of Artificial Sequence: Synthetic polypeptide
VKCTSPKQCSKPCKELYGSSAGAKCMNGKCKCY

SEQ ID NO: 1020 - protein, 33 aa, Artificial Sequence
  Description of Artificial Sequence: Synthetic polypeptide
VKCTSPKQCLPPCKEIYGRHAGAKCMNGKCHCS

SEQ ID NO: 1021 - protein, 32 aa, Artificial Sequence
  Description of Artificial Sequence: Synthetic polypeptide
VKCTGSKQCWPVCKQMFGKPNGKCMNGKCRCY

SEQ ID NO: 1022 - protein, 31 aa, Artificial Sequence
  Description of Artificial Sequence: Synthetic polypeptide
VKCRGSRDCLDPCKKAGMRFGKCINSKCHCT

SEQ ID NO: 1023 - protein, 27 aa, Artificial Sequence
  Description of Artificial Sequence: Synthetic peptide
VRCVTDDDCFRKCPGNPSCKRGFCACK

SEQ ID NO: 1024 - protein, 32 aa, Artificial Sequence
  Description of Artificial Sequence: Synthetic polypeptide
VPCNNSRPCVPVCIREVNNKNGKCSNGKCLCY

SEQ ID NO: 1025 - protein, 36 aa, Artificial Sequence
  Description of Artificial Sequence: Synthetic polypeptide
VPINVKCRGSRDCLDPCKKAGMRFGKCINSKCHCTP

SEQ ID NO: 1026 - protein, 37 aa, Artificial Sequence
  Description of Artificial Sequence: Synthetic polypeptide
VQTNVKCQGGSCASVCRREIGVAAGKCINGKCVCYRN

SEQ ID NO: 1027 - protein, 38 aa, Artificial Sequence
  Description of Artificial Sequence: Synthetic polypeptide
AEIIRCSGTRECYAPCQKLTGCLNAKCMNKACKCYGCV

SEQ ID NO: 1028 - protein, 36 aa, Artificial Sequence
  Description of Artificial Sequence: Synthetic polypeptide
RPTDIKCSASYQCFPVCKSRFGKTNGRCVNGLCDCF

SEQ ID NO: 1029 - protein, 37 aa, Artificial Sequence
  Description of Artificial Sequence: Synthetic polypeptide
QFTDVKCTGSKQCWPVCKQMFGKPNGKCMNGKCRCYS

SEQ ID NO: 1030 - protein, 37 aa, Artificial Sequence
  Description of Artificial Sequence: Synthetic polypeptide
VGINVKCKHSRQCLKPCKDAGMRFGKCTNGKCHCTPK

SEQ ID NO: 1031 - protein, 35 aa, Artificial Sequence
  Description of Artificial Sequence: Synthetic polypeptide
VVIGQRCYRSPDCYSACKKLVGKATGKCTNGRCDC

SEQ ID NO: 1032 - protein, 35 aa, Artificial Sequence
  Description of Artificial Sequence: Synthetic polypeptide
NFKVEGACSKPCRKYCIDKGARNGKCINGRCHCYY

SEQ ID NO: 1033 - protein, 38 aa, Artificial Sequence
  Description of Artificial Sequence: Synthetic polypeptide
QIDTNVKCSGSSKCVKICIDRYNTRGAKCINGRCTCYP

SEQ ID NO: 1034 - protein, 37 aa, Artificial Sequence
  Description of Artificial Sequence: Synthetic polypeptide
GVPISVRCRGSRDCLEPCRRAGTRFGRCINGRCHCTP

SEQ ID NO: 1035 - protein, 37 aa, Artificial Sequence
  Description of Artificial Sequence: Synthetic polypeptide
GVPISVRCRGSRDCLEPCRRAGTRFGRCIQSRCHCTP

SEQ ID NO: 1036 - protein, 37 aa, Artificial Sequence
  Description of Artificial Sequence: Synthetic polypeptide
GVPISVRCRGSRDCLEPCRRAGTRFGRCINRRCHCTP

SEQ ID NO: 1037 - protein, 37 aa, Artificial Sequence
  Description of Artificial Sequence: Synthetic polypeptide
GVPINVRCRGSRDCLEPCRRAGTRFGRCINSRCHCTP

SEQ ID NO: 1038 - protein, 37 aa, Artificial Sequence
  Description of Artificial Sequence: Synthetic polypeptide
GVPINVRCRGSRDCLEPCRRAGTRFGRCIQSRCHCTP

SEQ ID NO: 1039 - protein, 37 aa, Artificial Sequence
  Description of Artificial Sequence: Synthetic polypeptide
GVPINVRCRGSRDCLEPCRRAGTRFGRCIQSRCHCYP

SEQ ID NO: 1040 - protein, 37 aa, Artificial Sequence
  Description of Artificial Sequence: Synthetic polypeptide
GVPINVRCRGSRDCYEPCRRAGTRFGRCIQSRCHCTP

SEQ ID NO: 1041 - protein, 37 aa, Artificial Sequence
  Description of Artificial Sequence: Synthetic polypeptide
GVPINVRCRGSRDCLEPCRRAGTRFGRCIQSRCYCTP

SEQ ID NO: 1042 - protein, 37 aa, Artificial Sequence
  Description of Artificial Sequence: Synthetic polypeptide
GVPISVRCRGSRDCLEPCRRAGTRFGRCIQSRCHCYP

SEQ ID NO: 1043 - protein, 37 aa, Artificial Sequence
  Description of Artificial Sequence: Synthetic polypeptide
GVPISVRCRGSRDCYEPCRRAGTRFGRCIQSRCHCTP

SEQ ID NO: 1044 - protein, 37 aa, Artificial Sequence
  Description of Artificial Sequence: Synthetic polypeptide
GVPISVRCRGSRDCLEPCRRAGTRFGRCIQSRCYCTP

SEQ ID NO: 1045 - protein, 37 aa, Artificial Sequence
  Description of Artificial Sequence: Synthetic polypeptide
GVPINVRCRGSRDCLEPCRRAGTRFGRCIASRCHCYP

SEQ ID NO: 1046 - protein, 37 aa, Artificial Sequence
  Description of Artificial Sequence: Synthetic polypeptide
GVPINVRCRGSRDCLEPCRRAGTRFGRCISSRCHCYP

SEQ ID NO: 1047 - protein, 37 aa, Artificial Sequence
  Description of Artificial Sequence: Synthetic polypeptide
GVPINVRCRGSRDCLEPCRRAGTRFGRCITSRCHCYP

SEQ ID NO: 1048 - protein, 37 aa, Artificial Sequence
  Description of Artificial Sequence: Synthetic polypeptide
GVPINVRCRGSRDCLEPCRRAGTRFGRCINSRCHCYP

SEQ ID NO: 1049 - protein, 292 aa, Artificial Sequence
  Description of Artificial Sequence: Synthetic polypeptide
METDTLLLWVLLLWVPGSTGGSGVPINVRCRGSRDCLDPCRRAGMRFGRCINSRCHCTPGGSGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1050 - protein, 20 aa, Artificial Sequence
  Description of Artificial Sequence: Synthetic peptide
METDTLLLWVLLLWVPGSTG

SEQ ID NO: 1051 - protein, 39 aa, Artificial Sequence
  Description of Artificial Sequence: Synthetic polypeptide
GSGVPINVRSRGSRDSLDPSRRAGMRFGRSINSRSHSTP

SEQ ID NO: 1052 - protein, 4 aa, Artificial Sequence
  Description of Artificial Sequence: Synthetic peptide
GAGA

SEQ ID NO: 1053 - protein, 4 aa, Artificial Sequence
  Description of Artificial Sequence: Synthetic peptide
DEVD

SEQ ID NO: 1054 - protein, 4 aa, Artificial Sequence
  Description of Artificial Sequence: Synthetic peptide
LEHD

What is claimed is:

1. A method of selectively labeling a cancer cell in a subject, the method comprising:
   intravenously administering a peptide conjugate to the subject, wherein the peptide conjugate comprises an indocyanine green conjugated to a peptide having at least 90% sequence identity to SEQ ID NO: 9 having a structure of:

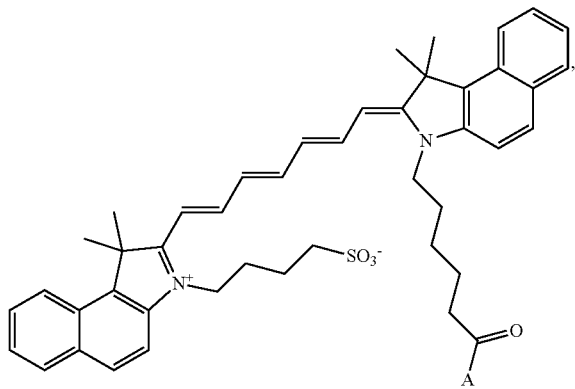

wherein A corresponds to the peptide having at least 90% sequence identity to SEQ ID NO: 9; and
   binding the peptide conjugate selectively to the cancer cell, thereby selectively labeling the cancer cell.

2. The method of claim 1, wherein the peptide has at least 95% sequence identity to SEQ ID NO: 9.

3. The method of claim 1, wherein the peptide is SEQ ID NO: 9.

4. The method of claim 1, wherein the cancer cell is labeled with a tumor to background ratio of at least 1.5.

5. The method of claim 1, wherein from 1 mg to 30 mg of the peptide conjugate is intravenously administered to the subject.

6. The method of claim 1, wherein the cancer cell is a brain tumor, a sarcoma, a lung cancer, a breast cancer, head and neck cancer, skin cancer, low-grade tumor, or a squamous cell cancer.

7. The method of claim 6, wherein the brain tumor is a glioma, an astrocytoma, a medulloblastoma, a choroid plexus carcinoma, an ependymoma, a meningioma, a glioblastoma, a ganglioma, a pheochromocytoma, a metastatic brain tumor, a neuroblastoma, a low-grade brain tumor, glioblastoma multiforme, an anaplastic astrocytoma, a low grade glioma, a pliocytic astrocytoma, or oligodendroglioma.

8. The method of claim 1, wherein the intravenously administering comprises administering a bolus of the peptide conjugate or an infusion of the peptide conjugate to the subject.

9. The method of claim 8, wherein the bolus of the peptide conjugate is intravenously administered to the subject over a period of less than 5 minutes.

10. The method of claim 8, wherein the infusion of the peptide conjugate is intravenously administered to the subject over a period of greater than 5 minutes and less than 15 minutes.

11. The method of claim 1, wherein the intravenously administering comprises administering an amount of the peptide conjugate such that an average maximum compound blood plasma concentration ($C_{max}$) of from about 1 ng/mL to about 100,000 ng/mL of the peptide conjugate is produced in the subject.

12. The method of claim 11, wherein the average maximum compound blood plasma concentration ($C_{max}$) of the peptide conjugate produced in the subject is from about 100 ng/mL to about 50,000 ng/mL.

13. The method of claim 8, wherein intravenously administering the bolus of the peptide conjugate or the infusion of the peptide conjugate produces a pharmacokinetic profile in the subject having a maximum time ($T_{max}$) of the peptide conjugate of from about 0.1 minutes to about 60 minutes in the subject.

14. The method of claim 8, wherein intravenously administering the bolus of the peptide conjugate or the infusion of the peptide conjugate produces in the subject an average area under the curve (AUC) of the peptide conjugate of from about 1,000 (hr)(ng/mL) to about 700,000 (hr)(ng/mL).

15. The method of claim 14, wherein the average area under the curve (AUC) of the peptide conjugate produced in the subject is from about 1,000 (hr)(ng/mL) to about 70,000 (hr)(ng/mL).

16. The method of claim 1, wherein the subject is a human.

17. The method of claim 1, further comprising imaging a tissue for a detectable signal from the peptide conjugate.

18. The method of claim 17, wherein the imaging is performed during surgery.

19. The method of claim 17, wherein the imaging is performed in a tissue sample isolated from the subject.

20. The method of claim 1, further comprising treating the subject by surgically removing or resecting the cancer cell.

* * * * *